United States Patent 8,299,321 (NUCLEIC ACID MOLECULES AND OTHER MOLECULES ASSOCIATED WITH PLANTS AND USES THEREOF FOR PLANT IMPROVEMENT) - sequence listing, part 3

SEQ ID NO: 7015 - protein, 819 aa, Oryza sativa
  Clone ID: PAT_MRT4530_86643C.1.pep
MAGLVIGYLAVQLSLMSLLLCPSSSTAQHTLGRSSMSVEDHARPFLVSTDGSFSCGFLEAGDNAFTFSVWFTADPNRTAVWSANRDAPVNGRGSRVSFSRDGELALADTNGTTVWSSKTTAGTGNRRGLTVSLRDTGNLVVGDPSTGLAVWQSFEWPTDTLLPSQRFTKQTKLVAGYFSLYFDNDNVLRMLYDGPEIASIYWPLPGLTVFENGRTNYNSTRIAILDDAGVFLSSDQTKAEATDLGLGIKRRITIEQDGNLRMYSLNASTGGWAVTWSALKQPCQAHGLCGKNGLCEYLPSLRCSCLPGYEMVDRRDWRRGCKPTFPVGNCSQGSAPPPSPATAPPQFKFIEVAQTDFFGFDLGYTESITFKQCRDQCMNNCQCTAFSYRLDGRGKCYPKGTLFNGFTSANFPGSIYLKVPLDFNASSPRVSAQRAAGLACGANVTVVTVSADVYGMAPGSNGQWTYFFVFAGVLGVLDILFIATGWWFLSSKQSIPSSLQAGYKMVMTSQFRRFTYRELKGATANFKEELGRGGSGAVYRGVLDGGKVVAVKRLAVDVTMQGDEEFWSEMTVLGRINHINLVRIWGFCSERKHKLLVYEYVENQSLDRHLFDASDGSGGKATTLAWSDRYKIALGTARGLAYLHHECLEWVIHCDVKPENILLTREFEAKIADFGLAKLSKRDGGAGVELTHMRGTSGYMAPEWALNLPINAKVDVYSFGIVLLEMVVGSRVADQRTEAGEPLQLPQITQALRHVVDSGDVMSLVDARLQGQFNPRQAMEMVRISLACMEERSCRPTMDDIAKSLTAFDDEDEHPAYHS

SEQ ID NO: 7016 - protein, 192 aa, Oryza sativa
  UNSURE (1)..(192): unsure at all Xaa locations
  Clone ID: PAT_MRT4530_86677C.1.pep
  unsure (1)..(192): unsure at all Xaa locations
PITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLXSHLRFFPWDADVDKFKAWRXGRTGYXLVDAGMRELWAPGWMHNRIRVICFKLCW

SEQ ID NO: 7017 - protein, 673 aa, Oryza sativa
  Clone ID: PAT_MRT4530_86747C.1.pep
MAGNLLANYVQVNVMLPLDVVTVDNKFEKVDETRAQLKKLTEAGVDGVMVDVWWGLVEGKGPGSYDWEAYKQLFRLVQEAGLKLQAIMSFHQCGGNVGDIVNIPIPQWVRDVGASDPDIFYTNRGGARNIEYLTLGVDDQPLFHGRTAIQMYADYMKSFRENMAEFLDTGVIVDIEVGLGPAGEMRYPSYPQSQGWVFPGIGEFICYDKYLEADFKAEAAKAGHPEWELPDDAGEYNDTPEKTRFFADNGTYVTEKGKFFLTWYSNKLIKHGDKILDEANKVFLGCRVQLAIKISGIHWWYRVPNHAAELTAGYYNLDNRDGYRTIARMLTRHRACVNFTCAEMRDSEQSSEAKSAPEELVQQVLSAGWREGLHVACENALGRYDATAYNTILRNSRPTGINKNGPPEHKLFGFTYLRLSDELLEGQNYSTFKTFVKRMHANLESSIYMRDPIPGNYPSSLTPCRDVVVIIASALLCQQRSRGTPPRRGARSGGLRAACRARSRRRTGWRFWKPSLPPAAAGGGSRPLGRGGTGSRTDRRFSAAQRGQFGLPANPAATGAAAEGRRPGELLRGCLSVSAAVFCSAASVRLVGPTLSCTISVRLPAFQRERRNGKRKGKDGSCLVFGREVAKQVGTFYTELVLLTVGARTHTLVHSGAVPLARNKFTLGFLIYR

SEQ ID NO: 7018 - protein, 549 aa, Oryza sativa
  Clone ID: PAT_MRT4530_8698C.1.pep
MSSEPPPDAAAAAASSAGDLAADLSSATISKKQLKKDARKAEKAEKASQRQQQQQPQADADDPFAANYGDVPVEEIQSKTISGRVWTEIGGLDEAAAGRSVLIRGAAQAIRPVSKKMAFVVLRESMSTVQCVLVASADAGVSTQMVRFATSLSKESIVDVEGVVSLPKEPLKATTQQVEIQVRKIYCINRAIPTLPINLEDASRSEAEIEKAEQAGEKLVRVGQDTRLNYRAIDLRTPANQAIFRIQCQVENKFREYFLSKNFVGIHSPKLIAGSSEGGAAVFKLQYNGQPACLAQSPQLYKQMAICGGFERVFEVGPVFRAENSNTHRHLCEFVGLDAEMEIKEHYFEVCDIIDGLFVAIFKHLNENCKKELETINRQYPFEPLKYLEKTLKLTYEEGIQMLKEAGTEIEPMGDLNTEAEKKLGRLVKEKYGTEFFILYRYPLAVRPFYTMPCYDNPAYSNSFDVFIRGEEIISGAQRIHLPELLTKRATECGIDASTISSYIESFSYGAPPHGGFGVGLERVVMLFCALNNIRKTSLFPRDPQRLVP

SEQ ID NO: 7019 - protein, 679 aa, Oryza sativa
  Clone ID: PAT_MRT4530_87187C.1.pep
MAASLLLRAARRRDLASPLGTLTANAQSAYSANICSQWGSFARAFSVKPTGNEVIGIDLGTTNSCVSVMEGKNPKVIENSEGTRTTPSVVAFNQKGERLVGTPAKRQAVTNPQNTFFGTKRLIGRRFEDPQTQKEMKMVPYKIVKAPNGDAWVETTDGKQYSPSQIGAFVLTKMKETAESYLGKTVSKAVITVPAYFNDAQRQATKDAGRIAGLDVQRIINEPTAAALSYGTNNKEGLIAVFDLGGGTFDVSILEISNGVFEVKATNGDTFLGGEDFDNTLLEFLVSEFKRSEAIDLAKDRLALQRLREAAEKAKIELSSTAQTEINLPFITADASGAKHLNITLTRSKFESLVNSLIERTREPCKNCLKDAGITTKEVDEVLLVGGMTRVPKVQEIVSEIFGKSPSKGVNPDEAVAMGAAIQGGILRGDVKELLLLDVTPLSLGIETLGGIFTRLINRNTTIPTKKSQVFSTAADNQTQVGIRVLQGEREMATDNKLLGEFDLVGIPPAPRGMPQIEVTFDIDANGIVTVSAKDKSTGKEQQITIRSSGGLSEAEIQKMVQEAELHSQKDQERKALIDIRNNADTTIYSVEKSLGEYRDKIPAEVATEIETAIADLRSVMTSDDIEKIKANIEAANKAVSKIGQHMSGGGGGAGGSETGGSQGGGEQAPEAEYEEVKK

SEQ ID NO: 7020 - protein, 51 aa, Oryza sativa
  UNSURE (1)..(51): unsure at all Xaa locations
  Clone ID: PAT_MRT4530_87581C.1.pep
  unsure (1)..(51): unsure at all Xaa locations
SIYRSVQKSLDLSPYTAVEKEKEVXRPRFKXKESSPLKEEAEPLLFYKDQL

SEQ ID NO: 7021 - protein, 267 aa, Oryza sativa
  Clone ID: PAT_MRT4530_87677C.1.pep
MPIYVMTALKIPKQIIQEIDKARRKFLWDGGDEFHGGKCKVNWQRVCRPIKYGGLGVSNLTKMGRALHLRWLWYEWTFPDKPWIGMPTPCDEQDAELFAASTTVTIGDSRKALFWESPWVSSSPLKTMAPNLYRHARRKKRTVANALQDNKWINDIRHNLTSMLVTEFFKVFEILWESNTTLSQDIRDGVSVGALRRLWQPEEDGRVVDGWRGEAAVGSGGDGAAGEATVPEAEVKVEELGVDAAGEESRRRGEVRVQPGELLPQLR

SEQ ID NO: 7022 - protein, 826 aa, Oryza sativa
  UNSURE (1)..(826): unsure at all Xaa locations
  Clone ID: PAT_MRT4530_87860C.1.pep
  unsure (1)..(826): unsure at all Xaa locations
MVKLAFGSCGDSFSASSIKAYVAEFIATLLFVFAGVGSAIAYGQLTKGGALDPAGLVAIAIAHAFALFVGVSMAANISGGHLNPVVTFGLAVGGHITILTGIFYWVAQLLGASVACLLCSSPPTDRLAIPTHAIAGISEIEGMVMEIVITFALVYTVYATAADPKKGSLGTVAPMAIGFIVGANILAAGPFSGSSMNPARSFGPAVAAGNFAGNWVYWVGPLIGGGLAGLVYDDVFIASYQPVMIGFTVILCDRSDQAVYAGQTSGDRAVTRCLGRVFAVMDRESAWCRMQSYIMAENYDIWRKVSLPYVIPEVINTAAEKIAFELNCKARNILLSGISCSDYDRVAHLQTAHEIWVALNNFHQGTNNIKEFRRDLFKKEYIKFEMKPGEALDDYLSRFNKILSDLRSVDSSYDANYPQSEISRHFLNGLDMSIWEMKVTSIQESVNMSTLTLDSLYTKLKTHEMNILSRKGDSKSSALVSSSTSLDVGASSSKSSVLALFNAMSDDQLEQFEEEDLVLLSNKFSRAMKNVRNRKRGEPNHCFECGALDHLRSHCPKLGRGKKEDDGRVKEDDVNKKKNMKEKEKKKHCIKWLIQKLIKVFDESEDEDESKGKQVVDLVFIARNESSHVDESDDDNEEKHSYDQLELAAYKFAKKTXTCSIVLDEKDHTIEILNAEIDRLKSSISDDDNCXSCEVLFSEINALRDANSVNCKKLEFXIEKSKTLESSFAIGFALHARVVDELILTKNVLXKKYKVAFCASSLVNASCVNKAKQNNGVLISQDCSKCVLNEMKLKDAFGRVIHMEEIVNQDEVLILMLIILDILLLC

SEQ ID NO: 7023 - protein, 235 aa, Oryza sativa
  UNSURE (1)..(235): unsure at all Xaa locations
  Clone ID: PAT_MRT4530_88073C.1.pep
  unsure (1)..(235): unsure at all Xaa locations
GHDAAQLLACLSDLNGLGILDLELMNKSLLGKWLWKLETEEGSWXDLFKAKYLYHTTLRHKKKKLSNGDSIFWQGLMQVRDDFLKSCSKEIGNGENTLFREYRWNGKEPFAVKYANLYNVAMTKNVTVAKVSRERWXVLSFRRKMEGKKXFPXQNLKKNFMNITLNNQKDSLVWELDRKXGFFVKSFYRALQIQQIKCPNRKKSELGVIMVIAVSCVKLLSAHNSTQHTSRKHKV

SEQ ID NO: 7024 - protein, 341 aa, Oryza sativa
  Clone ID: PAT_MRT4530_88123C.1.pep
MASEGVLLGMGNPLLDISAVVDDAFLTKYDVKLNNAILAEEKHLPMYDELASKGNVEYIAGGATQNSIRVAQWMLQTPGATSYMGCIGKDKFGEEMKKNAQAAGVTAHYYEDEAAPTGTCAVCVVGGERSLVANLSAANCYKSEHLKKPENWALVEKAKYIYIAGFFLTVSPDSIQLVAEHAAANNKVFLMNLSAPFICEFFRDAQEKVLPFVDYIFGNETEARIFAKVRGWETENVEEIALKISQLPLASGKQKRIAVITQGADPVVVAEDGQVKTFPVILLPKEKLVDTNGAGDAFVGGFLSQLVQQKSIEDSVKAGCYAANVIIQRSGCTYPEKPDFN

SEQ ID NO: 7025 - protein, 369 aa, Oryza sativa
  UNSURE (1)..(369): unsure at all Xaa locations
  Clone ID: PAT_MRT4530_88136C.1.pep
  unsure (1)..(369): unsure at all Xaa locations
MARTRFLAPRAAASAASAVSAKPAAVAPLYADRTVVRIGLPSKGRMSEQTLSLLKSCQLSVRHLNPRQYTADIPQVPNLEVWFQRPKDIVRKLQSGDLDLGIVGFDIVSEYGQGIDDLVVVHDALEFGHCRLSLAVPKEGIFENINTLEDLANMPEWTQERPLRVVTGFGYLXEKFMRENGFNHVSFLAGDGALESYPAMGMADVIVDLVSSGTTLRENNLKEIDGGVVLESQATLVACRRSLHKRNGVLEITHEMLERLEAHLTATGEIMVTANMRGNSAEEVAERVLSQTSLCGLQGPTISPVYRSRDGKVAVEYYAINVVVPQKSLYKSIQQLRSIGGSGVLVTKLTYIFDEETPRWRKLLSELGL

SEQ ID NO: 7026 - protein, 273 aa, Oryza sativa
  Clone ID: PAT_MRT4530_88198C.1.pep
MEHIARFFFGVSGNVIALFLFLSPVVTFWRIIKKRSTEDFSGVPYNMTLLNCLLSAWYGLPFVSPNNILVTTINGTGSVIEAIYVVIFLIFAERKARLKMMGLLGLVTSIFTMVVLVSLLALHGQGRKLFCGLAATIFSICMYASPLSIMRLVIKTKSVEFMPFLLSLSVFLCGTSWFIYGLLGRDPFIAIPNGCGSFLGLMQLILYAIYRNHKGATPAAAAGKGDAADEVEDAKKAAAAVEMADAKTNKVVADDADADADGKSADDKVASQV

SEQ ID NO: 7027 - protein, 1413 aa, Oryza sativa
  Clone ID: PAT_MRT4530_88374C.1.pep
MAPMLSIASRSPSPALIAPHASARATGLRAPFAGNRIVGWGWGDQTKSGTDRNRASICVVLFLRVRSGEPTQAPRDPPAAVGGGGCYVRLPAPPRDRDAVLYHVCLFTLLLCFIPITALAESDIKNLFALRKAIAVGKGFLHNWFELETPPCNWSGISCVGLTVVAIDLSSTPLYVDFPSQIIAFQSLVRLNVSGCGFSGELPEAMVNLQHLQHLDLSDNQLGGPLPASLFDLKMLKVMVLDNNMFSGQLSPAIAHLQQLTVLSISTNSFSGGLPPELGSLKNLEYLDIHTNAFSGSIPASFSNLSRLLYLDANNNNLTGSIFPGIRALVNLVKLDLSSNGLVGAIPKELCQLKNLQSLILSDNELTGSIPEEIGNLKQLEVLNLLKCNLMDTVPLSIGNLEILEGLYISFNSFSGELPASVGELRNLRQLMAKSAGFTGSIPKELGNCKKLTTLVLSGNNFTGTIPEELADLVAVVLFDVEGNRLSGHIPDWIQNWSNVSSISLAQNMFDGPLPGLPLHLVSFSAESNRLSGSIPAKICQGTFLQILRLNDNNLTGSIDETFKGCKNLTELSLLDNHLHGEIPEYLALLPLVSLDLSHNNFTGMIPDRLWESSTILDISLSDNQLTGMITESIGKLLSLQSLSIDRNYLQGPLPRSIGALRNLTALSLSGNMLSEDIPIQLFNCRNLVTLDLSCNNLTGHIPKAISHLTKLNTLVLSRNRLSGAIPSELCVAFSRESHSELEYVQHIGLIDLSRNRLTGHIPRAINNCSILVELHLQDNLLSGTIPVELAELRNITTIDLSSNALVGPVLPWPVPLASLQGLLLSNNRLSGSIPSGIGNILPQITMLDLSGNALTGTLPLDLLCKESLNHLDVSDNNISGQIPFSCHEDKESPIPLIFFNASSNHFSGSLDESISNFTKLTYLDLHNNSLTGRLPSAIARVTSLYYLDLSSNDFSGTIPCGICGMFGLTFANFSGNRDGGTFTLADCAAEEGGVCAANRVDRKMPDHPFHVLEATICCIATAIVIVLVVILVVYLRRRRKMLRRRQFVLVPAGDNAMADHETTLSNNLLGRRRMKKREPPSINLATFEHAPVRVTVDEIMRATGNFDGMHVVGDGGFGTVYRAELPGGRRVAVKRLHGVGRRFQGGEREFRAEMETVGKVRHPNLVPLLGYCAAGDERFLVYEYMEHGSLEDRLRGGGGAALGWPERLTICGGAARGLAFLHHGFVPHVIHRDVKSSNVLLGEGLQPRVSDFGLARIISACETHVSTVLAGTLGYIPPEYALAMRCTAKGDVYSFGVVMLELLTGRPPTWSSAEVTAEGDDERGGGGSLVGWVRWMAARGRGGEVFDACLPVSGAEREQMARVLDVARDCTADEPWRRPTMAEVARRVGAIEAMEYGPLVVAVSSGEPPAMP

SEQ ID NO: 7028 - protein, 352 aa, Oryza sativa
  Clone ID: PAT_MRT4530_88443C.1.pep
MGHGVTVNVIDRCELHEIPLQNRKFTWSNERRKATLVKLDRCFCNEEWDLAFPHHVLHAFPTGPSDHCPLVLSNPQGPHRPRTFKFENFWTRVPGFKDKVKDIWSQPSSHTEPMHHLNQKLQRTAVGLRDWTKGICSEAKLQFHMALNVIQRLDVAQEHRELSPPETRLRAALKRKVLGLASIERARKKQASRVTHIREGDANTKFFHLRVNARRRRNTIQRLKKDSGWAVTHGEKELTIHDHFASFMGRPGPRPNELNWETLDITPIDLATLGEPFTEEEVHRAIKEMPADKAPGPDGFTGAFFKVCWEIIKDDILLVFSSIYNLRSQGLPDKMDRLARGFTVVFDIPSPP

SEQ ID NO: 7029 - protein, 646 aa, Oryza sativa
  UNSURE (1)..(646): unsure at all Xaa locations
  Clone ID: PAT_MRT4530_88449C.1.pep
  unsure (1)..(646): unsure at all Xaa locations
MQQLDVAQEHRELSXPPETRLRAALKRKVLGLASIERARKKQASRVTHIREGDANTKFFHLKVNARRRRNTIQRLKKDSGWAVTHGEKESTIHDHFASFMGRPGPRPNELNWETLDITPIDLATLGEPFTEEEVHRAIKEMPADKAPGPDGFTGAFFKVCWEIIKDDILLVFSSIYNLRCAHLNLLNSANIVLIPKKDGAESVSDYRPISLIHSIAKIFAKMLALWLRPHMHELISVNQSAFIKGRSIHDNYLFVRNMTRRYHRLRRAMLLFKLDITKAFDSVRWDYLLALLQRKGFSTRWIDWLGALLSSSTSQVLLNGSPGQRIKHGRGLRQGDPLSPLLFILAIDPLQRILSKATELGAISKLRGRTTRLQISMYADDAVIFINPTRNDVATFANILHRFGTATGLVTNLQKSQVAAIRCGNIDLEEVLQGVPAKRANFPLKYLGLPLVLGRLRKTDLQPVFDKISGRVASWRGKNMAVAGRTTLVKSVLSAQPIYLLTALKVTKESLEQLDKQRHRFLWAGTGDITGGKCKVNWAKTCLPTSQGGLGVLSLDKFTRALRLRWLWNEWRDPSKPWVGLETPCDGVDRDLFAASTKITVGDGNTTRFWDSAWINGQRPKDLMPLVYEISKNRKKSLRQGKEDDS

SEQ ID NO: 7030 - protein, 1951 aa, Oryza sativa
  Clone ID: PAT_MRT4530_88450C.1.pep
MTPRRGELLPTMLACLRVASPSRTWAALSPENRAGSGFSGSIGGDVQSIQAESIQAGRTGHLQGETTSSGLGEAASPTATFGRRSVGNVSFASPAATVQPSVEIQSAASSAVAPAIGRATVATATLRTARLDSAALLALTVLGSRPLHHVEFVLPHTPRLRLANALHLAVVPTRAAFLTRTPPPLVAPARQRIRHATAPPLLHCRHPPSRIPSPGPRRRLRDRPWLRLVSWAARAPPTTEPRDVEQAFLDEFKLRRGEVAVSLHHPQAFLIKFQHRRHCEEALAKGYVKRHGIEIHFIKWRSLKSALGVALMFRVRLCLDGVPMHAWAADIAERIIGRTCALEQIETDVVHPVESGNTRSIDLWAWTANPSTIPKRMWLGFTKRAKDPNLAPLFAVENPLEHWQRGVRHPVLFHLEEIHDYTAATIDLEGQGSFQPAKRRLPPWSLGVLDGEQVPGRVFEDFPHHPPPPRSVHERLGGRDRDDERREARRPERRSDRDAIDGRADRPRRGRAVRGGHLHDEGDHDDEDDWDGERDDRDGCADRDGRHARDQGGRGGRGRRRGSGNDHPRPWRRNDRDDDRDDRGRDLGRGRDDRRGSDNNYRRERTRSPRRWDRGGANRSGGGTRRTADPVYDSSKLMNIPLLHKSANQAEVGEFRLLHALHNSSFLCQEPQTNTLSPVSQLQWLSIIADKAATPALSGRPAKPRIEAWFQNAAWEPIPVEHAFARIKSALPPPTSTTTCQQVEEALLRIELAAAATDPPVGEPFPQIDSPPPRVTSPALAQGPVVPTGAMEIDDIVAPPPPSPVATQLAQAAASASPISTGVLDALFASPPQPIIASPPRSPPRSPCARPLHMGRRLKIRTRQHSQPTRRSERIAKQPARPTMERCQRVLFKRLGVLNGEEGASIEQVIAEYVAMFDGPLPAHVIAALTTIFGIDDEEQETMDAALISLVGEANVGKNFVFLLFHLRAVVFAPAPTDCYLISWNVRGLNSPARCNVVHELMLDTKCTLACFQETKLQSIDDGLARFLGGYKLDKFAFKPARGTRGGILLLWSSGDFDVQEVRIGRFSISAQITDIRSGVTFLLTGVYGPTRHHLKDSFLRHIRRLRPSPGEGWLILGDFNMIYRARDKNNSNLNLARMRRFRAVIDRCELHEIPLQNRKFTWSNERRKATLVKLDRCFCNEEWDLAFPHHVLHALPTGPSDHYPLVLSNPQGPHRPRTFKFENFWTRVPGFKDKVKDIWSQPSSHTEPMHRLNQKLQHTAVGLRDWTKGICSEAKLQFHMALNVIQRLDVAQEHRELTPLETRLRAALKRKVLGLASIERARKKQASRVTHIREGDANTKFFHLKVNARRRRNTIQRLKKDSGWAVTHGDKELTIHDHFASFMGRPGPRPNELNWETLDITPIDLATLGEPFTEEEVHKAIKEMPADKAPGPDGFTGAFFKVCWEIIKDDILLVFSSIYNLRCAHLNLLNSANIVLIPKKDGAESVSDYRPISLIHSIAKIFAKMLALRLRPHMHELISVNQSAFIKGRSIHDNYLFVRNTIRRYHRQRRAMLLFKLDITKAFDSVRWDYLLALLQRKGFPTRWIDWLGALLSSSISQRILSKATELGAISKLRGRTTRLRISMYADDDVIFINPTQNDVATSANILHRFGTAIGLVTNLQKSQVAAIRCGNIDLEEVLQGVPAKRANFPLKYLGLPLALGRLRKTDLQPVFDKISGRVASWRGKNMAAAGRTTLVKSVLSAQPIYLLTALKVMKESLEQLDKQRRRFLWAGTGDITGGKCKVNWAKTCLPTSQGGLGVLSLDKFTRALRLRWLWNEWRDPSKPWVGLETPCDGVDRNLFAASTKITVGDGNTTRFWDSAWINGRRPKDLMPLVYEISKNRKKSLRQGKEDDSWVHDLTLDAGLSITINLLDQLVRLWEANCKKCQGYQLLDYLSLSGPITVSRARSASP

SEQ ID NO: 7031 - protein, 1076 aa, Oryza sativa
  Clone ID: PAT_MRT4530_88573C.1.pep
MAANAGMVAGSRNRNEFVMIRPDGDAPPPAKPGKSVNGQVCQICGDTVGVSATGDVFVACNECAFPVCRPCYEYERKEGNQCCPQCKTRYKRHKGSPRVQGDEEEEDVDDLDNEFNYKHGNGKGPEWQIQRQGEDVDLSSSSRHEQHRIPRLTSGQQISGEIPDASPDRHSIRSGTSSYVDPSVPVPVRIVDPSKDLNSYGINSVDWQERVASWRNKQDKNMMQVANKYPEARGGDMEGTGSNGEDIQMVDDARLPLSRIVPIPSNQLNLYRIVIILRLIILMFFFQYRVTHPVRDAYGLWLVSVICEIWFALSWLLDQFPKWYPINRETYLDRLALRYDREGEPSQLAPIDVFVSTVDPLKEPPLITANTVLSILAVDYPVDKVSCYVSDDGSAMLTFEALSETAEFARKWVPFCKKHNIEPRAPEFYFAQKIDYLKDKIQPSFVKERRAMKREYEEFKVRINALVAKAQKVPEEGWTMADGTAWPGNNPRDHPGMIQVFLGHSGGLDTDGNELPRLVYVSREKRPGFQHHKKAGAMNALIRVSAVLTNGAYLLNVDCDHYFNSSKALREAMCFMMDPALGRKTCYVQFPQRFDGIDLHDRYANRNIVFFDINMKGLDGIQGPVYVGTGCCFNRQALYGYDPVLTEADLEPNIVVKSCCGGRKKKSKSYMDSKNRMMKRTESSAPIFNMEDIEEGIEGYEDERSVLMSQKRLEKRFGQSPIFIASTFMTQGGIPPSTNPASLLKEAIHVISCGYEDKTEWGKEIGWIYGSVTEDILTGFKMHARGWISIYCMPPRPCFKGSAPINLSDRLNQVLRWALGSVEILLSRHCPIWYGYNGRLKLLERLAYINTIVYPITSIPLIAYCVLPAICLLTNKFIIPEISNYAGMFFILLFASIFATGILELRWSGVGIEDWWRNEQFWVIGGTSAHLFAVFQGLLKVLAGIDTNFTVTSKASDEDGDFAELYVFKWTSLLIPPTTVLVINLVGMVAGISYAINSGYQSWGPLFGKLFFSIWVILHLYPFLKGLMGRQNRTPTIVIVWSILLASIFSLLWVKIDPFISPTQKAVALGQCGVNC

SEQ ID NO: 7032 - protein, 354 aa, Oryza sativa
  Clone ID: PAT_MRT4530_88663C.1.pep
MGVGGEKFQLGTVGALSLSVVSSVSIVICNKALMSSLGFNFATTLTSWHLLVTFCSLHVALWMKFFEHKPFDSRTVMGFGVLNGISIGLLNLSLGFNSVGFYQMTKLAIIPCTVILETLFFRKKFSRSIQLSLSVLLFGVGVATVTDLQLNAVGSVLSLLAIITTCIAQIMTNTIQKKFKVSSTQLLYQSCPYQSLTLFLIGPFLDGFLTNQNVFAFDYTSQVVFFIVLSCLISVSVNFSTFLVIGKTSPVTYQVLGHLKTCLVLTFGYVLLHDPFSWRNILGILIAVVGMVLYSYFCTLEGQQKNAEVSPQQAKEGDSAPLISDSLSKVENGGGVVDDEPLKVPMWSSKYSRA

SEQ ID NO: 7033 - protein, 308 aa, Oryza sativa
  Clone ID: PAT_MRT4530_88712C.1.pep
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEALPIYVVLGNLAADSLLGWWILELHFLWGEPQGGTFMSLIGSIVFGMSVVSLISRVHSPAKCPA

SEQ ID NO: 7034 - protein, 262 aa, Oryza sativa
  Clone ID: PAT_MRT4530_88714C.1.pep
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 7035 - protein, 1422 aa, Oryza sativa
  UNSURE (1)..(1422): unsure at all Xaa locations
  Clone ID: PAT_MRT4530_88759C.1.pep
  unsure (1)..(1422): unsure at all Xaa locations
MAVTSDTVLDPLGGKSRGDSASIGAIATDDGPSREPAWTVQEVLVTEDGLAAEDGPTDGDGPADGDGLSAIVLPATEDGLLATPARLTRPVGLTEFPLVYSRRRCPAQAVAVDQGALAAVGRRAREERATDENEAPPEVQARISAFISSISTTPPPSILGGPPASVPVTRTRRRATILEGFTPWRSPRLALQGNGTRRHTISKAQKVTMKKLGIIEEEEEANQEAVQEFEKLFDEPLPPHHVQAIAELLQIDMAAPLQPLPEVLPGVEESKLSAVNQSLIYELCGLDFDGFVFLPAEETRGGVIIAWKSALFRGDVVHIGTWSVTVNLCWLAANRSWSLTSVYGPQGDEEKLLFLEELSVIREICLGEWLIAGNFNLIAAAEDKNNSRINRRLLNAFRSKINDLELKEMYMFGRRYTWSSEQARPTLVKLDRILVTTSWEDLFPEAHLQALSSSNSDHCPLLLTCGEFKPISRRFRFETFWTKLDGFMEVVKESWERSVDSTDPFCILYVKMARLSKILSKWGQKKMSNFRLQLQIANEIILRFDVAQEIRILSDLERQLRAALKGRCLALASLERIRIRQRARVRNLREGDASTAYFFMKMKSHQRKLKILWLEHDGVIATTQEDMEQMAKTHFEYVMGASQGDLKQILFQEIHLARANLSELDDAFTEEEVWATIKAMQNEKSPGPDGFTGLFYQRCWDVIKKEVLEALHKFCTGNSQNLELLNTAIITLLPKKDAPTLLKDFRPISLIHSFAKLATKILALRLAPRMDELVAHSQSAFIRGRSIHENFIFVKGLATQFHRNHKAMLLFTLDISKAFDSVSWSFLLNMLRFRGFGPKWRSWVAALFLTAETRVDLNGALGESFKPQKGLRQGDPLSPLLFVLQTTTIGLIDKVNLRNRAPNISIYADDAIIFLKPLVHEVEAVKALLNLFGTATGLHINFSKSAVTPIRCAESQKTLAQNTLACRLEDFPITYLGLPLSIRKPTKAEVQPTLDKMAKKVAGWKPKLLSPDGRLCLIKSVLMAIPVHFLSVLQLPRWAIKEMERRRRVFLWKGQEEINGGHCLVAWRDLCRPISNGGLGIKDIDLFGKALRMKWDFKRLEHKDRPWTMAGWGTDRDLQDIISSTAVHMLGDGCDTNFWRGNWLPGDGSIASRWPILFSFVGRANLTISQGLSNNTWVRRLQGSLSGRALLDYLALWDELQLVQLQQGVEDSILWKFSTNGQFSVASAYEFFFLTAVRCPYGEMIWKARAPARGALSNEAMGEFFQLWDEVHDFSLLPSPDEIRWKLTGDGKFSAASAYDVFFIAAEDCPYGELLWRSRAPSRVRFFMWLALKDRCLTXTILRSEIGRTTPSARCVREKTRIATTCLXPVLLRRRYGERSEDGAMQTLQSRQTVTADLLTGGLQRDAVFGRATKWTSTVPSC

SEQ ID NO: 7036 - protein, 512 aa, Oryza sativa
  Clone ID: PAT_MRT4530_88764C.1.pep
MPGGSLLNSGGMADYGGGGGSGGGLTFPVVVTCLMAASGGLIFGYDIGISGGVSEMESFLEKFFPGLLKGTAHASKDVYCIYNSQALTAFTSSLYAFGMVGTLVASRVTRRTGRQAVMLIGGSMFLVGALVNAAAVNIAMLIIGRMLLGLGLGFSGQATPVYLAEMSPPRWRGGFISGFPLFISVGYLIANLINYGTSRIPVWGWRLSLGLAAFPAAVMVAGAAFIPDTPSSLVLRGKHDLARAALQRVRGKGVDVDAEFNDILAAVEHDRRNDEGAFRRILRREYRPYLVMAIAFPVFLNLTGVAVTAFFSPILFRTVGFESDAALMGAVILGLMNIFGIVGSGFAMDRYGRRLLFMIGGALMFTCQVAMASIVGSQLGHGSKMAKGYAVTVLVMTCAFSASFSWSWGALYWAIPGEIYPVEVRSAGQGVAVALNLGLNFVQAQCFLAMLCCFKYGTFLFYASWLVVMTAFAVAFVPETKGVPLESMGHVFARHWYWGRFVKDHKFGDVST

SEQ ID NO: 7037 - protein, 427 aa, Oryza sativa
  Clone ID: PAT_MRT4530_88794C.1.pep
MAATIQSVKARQIFDSRGNPTVEVDICCSDGTFARAAVPSGASTGVYEALELRDGGSDYLGKGVLKAVDNVNSIIGPALIGKDPTEQTVIDNFMVQQLDGTKNEWGWCKQKLGANAILAVSLALCKAGAIIKKIPLYQHIANLAGNKQLVLPVPAFNVINGGSHAGNKLAMQEFMILPTGASSFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATLLRIEEELGAAAVYAGAKFRAPVEPY

SEQ ID NO: 7038 - protein, 888 aa, Oryza sativa
  Clone ID: PAT_MRT4530_89025C.1.pep
MSRHPEVKWAQRIDKVYITVQLADAKDAKVNLEPEGVFSFSATAGTDGNLYESKLELNDKVNVEESKISVGVRSIFCIVEKAEAKWWKKLVRDDQKAPHFVKVDWDKWVDEDDDGADVNVDGMDFSNFGGMGGMGGMGGMGDMMGGMGGMGGMGGMAEMMGGMGGMGGMGGMGGMDEFEDESDDEGSIIFAVWYDTNLNHMHQKFLNHYTYILVRKLFDACKVSVTRCRLRMSGDMPIRLYYGDAPIQICDSGVDLTVYAFHDTSLNAPEHMGLNDVLGWLYNMFGVDPVHDKFVINTVWPVRGQHEWQWRVVEVASTGSWRKFVSKVREKGYSLAIVVQKTTCVDRSGESSHAVVEETPLEGGQAENVWRTEQGRGEEVVEGNTQGEVIVRGTNREANDSDDEEPDSPMRVDAAEENEVVVDQMEVENEEYLALVVEGEDTTLWDNETNIPDDWTTISMSRMKVNDGLDAHWCYDSKQVKVGQMFHDKGHLQDAVKRWAFVQKREFRVKVSNRTTYDVKCIQGGCPWRVHGYKPQHDTLWVGSRVEQHTCLLENTRLVHRNLTAAFVAQMVYSKVVRKTSLSPFTIMHDVEKEYGYEISYDKAWRAKQKALEMRFGTHEDSYHNLPPLLEVMQARNPGTHMAILDEVNEYGENILRRAFWSFGCMIEAFRNCIPLLCVDGTFMTGKYRGTILTAIGVDTDSHVVPVAFAFVESKNTSSWLWFLRHIKMCVVENRLNVCVLHDRHAGLLSAIQKLQEDVTQSVPWPDLHSRWCMRHFGANFYRQFRNDEYGSASTHHGMPAYSPRTAFIEDFFSTDPPQGEVGMDYWHAAPQVTQPTQETEAGQGPDVTPQQAARDRLPPDNLTYPTEQIRHRKKGGPSKRAKGTDRP

SEQ ID NO: 7039 - protein, 1018 aa, Oryza sativa
  Clone ID: PAT_MRT4530_89052C.1.pep
MDCNKDEAVKAKALAEKKMREKDFAGAKRMINKAQNLSKDVDSNISQMLTVCDIHCASATKVNGEIDWYGILQVPVTADDTLIKKQYRKLALLLHPDKNNFAGAEAAFKLVGEANMTLTDRSKRSVYDMKRNASVRIGSARVPYQQSRRTAPVRPTTTPVNLHNVHQSQQHKPSNPSDSQTFWTICPTCGMRYQYYLSILKKALRCQNCLKPFVALDLNEQAVPSGANQRSAGVWKSSGAPQNFPGSQANVGQQAQNSANPVHANFGSHNAHVETKRGADGNEAGGLKNKRKFAKATGNSSKASSVAGSKKRRKAMFESSESSASDTSTDSEEEIIEDGPAASNVGPDQHPRRSSRQKQEVKYNEDSDGDDTDCHGNGDDGFVSSPSLKRLRKGGLFHGGENNETKLNADTTGPGHDGPTNGVNNYNNTEDIERGSACAEQIKRETMSGGGNSAEKEKLSHSVSNNGLESNSDDAPNEVICADSEFFDFNQLRHINQFKANQIWACYDSQSCMPRYYARITKVKHVPKFMLNFIWLEFDPKNKAEAAWSSGDLPVSCGRFKHGVSDTAKESSMFSHAIFYEKNKTRNSYEIYPRKGEVWALFKGWDIDWSADADKHKNYEYEVVQVLSDLTSSTSIIVMPLVKIKGFVSLFIQSKEASPYVIPQDDTLRFSHCVPRHTMIGTEKEGIPEGAIELDPAALPLNFGVAFASVVPESCCSVKVQGSGAEHIGSSSGNNCHKGSVDVGESQHATCANTGFATRTTKAEINEHNARSAVEGTDDDEEPDDFAQAEVLYPESEFFEFSEIRSIHKFQPGQIWALYSDVDKFPNYYACIKTVDVKNNELQVRWLDACPQSEEERRLVREDLTVACGTFKISSFHGIQTYNGTEYLSHPVQAKPGRRNEYEIVPCQGDIWAVFKNWRTGWTAKDYKKCDYELVEIFGHTDSSIQVQLLRKVDGYRAVFMPDRREGAVKTIRKDEYPKFSHQIPCFHLTNERGGKLRGFLELDPLSVPEMFLFTESI

SEQ ID NO: 7040 - protein, 935 aa, Oryza sativa
  UNSURE (1)..(935): unsure at all Xaa locations
  Clone ID: PAT_MRT4530_89113C.1.pep
  unsure (1)..(935): unsure at all Xaa locations
GPHRQPPSRVATSSPXMPIRLYYGDAPIQICDSGVDLTVYAFHDTSLNAPEHMGLNDVLGWLYNMFGVDPVHDKFVINAVWPVRGQHGWQWRVVEVASTGSWRKFVSKVREKGYSLAIVVQKTTCVDRSGESSHAVVEETPLEGGQAENVWRTEQGRGEEVVEGNTQGEVIVRGTNREANDSDDEEPDSPMRVDAAEENEAVNDGLDAHWCYDSKQVKVGQMFHDKGHLQDAVKRWAFVQKREFRVKVSNRTTYDVKCIQGGCPWRVHGYKPQHDTLWVASRVEQHTCLLENTRLVHRNLTAAFVAQIVYSKVVRKTSLPPFTIMHDVEKEYGYEISYDKAWRAKQKALEMRFGTYEDSYHNLPPLLEVMQARNPGTHMAILDEVNEYGENVLRRAFWSFGCMIEAFKNCIPLLCVDGTFMTGKYRGTILTAIGVDADSHVVPVAFAFVESENTSSWLWFLRHIKMCVVENRPNVCVLYDRHAGLLSAIQKLQEDVTQSVPWPDLHSRWCMRHFGANFYRQFRSKRLMDLFKKLCKQNQQRKFDAIWEQLDRLTTTHMEEVRKKPIVARQEEPEGLEPIPNEAPSITRRRKRGRATKCFTEWVEFEPREKWSLLYDTDGSRYGVMTTNLAEVYNWVMKNTRPLPLVAILEGITRGTQKYLCKRYSMASLNLSKPSVKYSPAITQYMDEKSKKGGIHRVWHAGNRELLFEIRLRDKSGVGIGTTDITLECTLWPEYHACKCNCNKPYLLHRPCSHVLAASAKGGVDGNIFVSPYFRKESWEATWRGELRGWRAVCDFTRPPPGQANWVPDSNLLVDTKGHRQSRRIKNLMDEAEVKDRSRRMADQNDGQLIDKEIDRNQSRATHSTHGEVGMDYWHAAPQVTQPTQETEAGQGPDVTPHQAARDRHPPDNLTYPTEQIRRRKKGGPSKRAKGTDRP

SEQ ID NO: 7041 - protein, 365 aa, Oryza sativa
  Clone ID: PAT_MRT4530_89433C.1.pep
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 7042 - protein, 771 aa, Oryza sativa
  Clone ID: PAT_MRT4530_89498C.1.pep
MPRKVVSGPDYDDEYDDDYDEYDEDYDDYGETGHSDDIQHPVKEEKESSKKSSSTVPVLWRCSMCMFDNHESMVYCEMCGVFRESFMKSAKDGSIKVHGIPSDFGTPSMPKSDCTKMPVNTRTTDFDGDPEIKNASISHEKVGSTQYTSAGSSSGAGKKVKHIALPEDVPVERTAQLISDHFQLKEDQSSRASSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETKKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRSCNFKDSSVTWIPLSAVENQNLIKIPSDVRLTSWYQGFCLLDAIDSLQLPSRDVSKPLILPICDVIKSQSTGQFAAFGKLETGAIRIGSKVLISPCGEVAAVKSIERDSNSCDIARAVPVSNFLELRVLVLDVTIRILIGYQVEFHIHHVKEAARVTKIVALLDKAGKPSKTAPRFLKSKQNAVVQVTLDAPVCVQEFSKCRALGRAFLRSSGSTIAVGVVTRPCFGAHIVADSKRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 7043 - protein, 814 aa, Oryza sativa
  Clone ID: PAT_MRT4530_89500C.1.pep
NPSPLEAQVRRCVSRMPRKVVSGPDYDDEYDDDYDEYDEDYDDYGETGHSDDIQHPVKEEKESSKKSSSTVPVLWRCSMCMFDNHESMVYCEMCGVFRESFMKSAKDGSIKVHGIPSDFGTPSMPKSDCTKMPVNTRTTDFDGDPEIKNASISHEKVGSTQYTSAGSSSGAGKKVKHIALPEDVPVERTAQLISDHFQLKEDQSSRATSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETNKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRACNFKDSSVTWIPLSAVENQNLIKIPSDVRLTSWYQGFCLLDAIDSLQLPSRDVSKPLILPICDVIKSQSTGQLAAFGKLETGAIRIGSKVLISPCGEVATVKSIERDSNSCDIARAGDNVAVSLQGIDGSKLIAGGILCNPGFPVPVSNFLELRVLVLDVTIPILIGYQVEFHIHHVKEAARVTKIVALLDKAGKPSKTAPRFLKSKQNAVVQVTLDAPVCVEEFSKCRALGRAFLRSCGSTIAVGVVTRPCFGAHIVADSKRDIKDPEHPYSLEELNVVTEDSVEINDELSHVRVTFTPTVERCSMATVIGLCLRVKLMRSLPPRYKVDIRVAPGSHATETAVNKQLNDKERVAAALENPNLLDIVEECLSPTFA

SEQ ID NO: 7044 - protein, 1076 aa, Oryza sativa
  UNSURE (1)..(1076): unsure at all Xaa locations
  Clone ID: PAT_MRT4530_89648C.1.pep
  unsure (1)..(1076): unsure at all Xaa locations
MAKTLQGTQQQYAASGFPTQQYPTSGWTQSAAEILQLDNMDQDTSVVRNIIHRKIVEYLNERKEFCNFDLSFLMEIGKCIDRHLFEKADSKIKYMDLETLRTRLNAIVNSASFRGRYNQYENCMGAANFAHSLADKPKQMPERLANTIFTSCASTLPKCSPSIDVLHIGHIKEHFSGDAYQNDSSQPSTSGSSSSLSAVWDQTTCSSAMRTLPMDSFSTVNGQNLSTNNKSLYPTTGQGPLLQQYIECEMKQETWSRSLEQSDQSNITTGNRDLYHAQIHPYINGEHKRDRCIQMKEKLGHTSDHEGFSREKSSNLSNHFMHHQQGFMTNYGACSPVSKTVDRAEQTSNSTVSKPTSPASDGSSGKHYPAKRLKVDVPHLVHVNEMEASKEQQPAANETYASAETVQSEVTNSPTKSPCCTSLGDNIACTDNVHGMDMVRLSGSAVQTEEEFRRENSDIEMKDAKVDLLDQTLSGDSLRARKRRGASVLYALTSEELKDHLCTLNHDTSQSKVPTEELLSVEGLPDQNTCNLCGMERLLFEPPPRFCALCFKIINSTGSYYVEVENGNDKSSICGRCHHLSSAKAKYQKRFSYAETDAEAEWWVQCDKCKAWQHQICALFNPKIVDPEAEYTCAKCFLKEKDNEDVDSLEPSTILGARELPRTRLSDHIEQRLSERLVQERQQRAIASGKSVDEVPGVEGLTVRVVSSADRTLQVQPRFKDFFKKEQYPGEFPYKSKAILLFQKNEGVDVCLFAMYVQEYGSACPSPNQRHVYLAYIDSVKYFRPEIKSASGEALRTFVYHEILIGYLDFCKKRGFVSCSIWTCPSTKRDDYVLYCHPTIQKMPKSDKLRSWYQNLVKKAVKEGVVVERNTLYDFFLQPTNECKTNISAAWLPYCDNDFWPGEAERLLEKKDDDTSQKKETQLGRLLRVAKRDDRKGNLEDILLVHKQFCKHCHHPIVSGSSWVCTSCKNFFLCERCYAEELNTPLKDRHPATTKQKHAFERDYLEGLVHASRCFDRSCTSKLCLTLXNCSSMVYDVIPVPVVEEVAICVYSCGNCCSRTHCFVTMQTVQLPDAGI

SEQ ID NO: 7045 - protein, 535 aa, Oryza sativa
  Clone ID: PAT_MRT4530_89679C.1.pep
MGMEVAAARLGALYTTSDYASVVSINLFVALLCACIVLGHLLEENRWVNESITALIIGLCTGVVILLMTKGKSSHLFVFSEDLFFIYLLPPIIFNAGFQVKKKQFFRNFMTITLFGAVGTMISFFTISIAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 7046 - protein, 42 aa, Oryza sativa
  Clone ID: PAT_MRT4530_89985C.1.pep
PEAGEGGGDGARGLPTEEAIAWFISVTPVLGSPASYKHQIKF

SEQ ID NO: 7047 - protein, 762 aa, Oryza sativa
  Clone ID: PAT_MRT4530_90081C.1.pep
MNHKHSFSALCAAMILNVIILFVDSYVAVASDTLFPGQSLSGSETLVSENGIFELGLFPSAPAGTKHYLGIRYKNMSSNNPITFWLGNRIPITYFINATLYIDAGKLYIEELGSILWTSNSTRNESNTAVAVILNTGNFVIRDQLNSSVVTWQSFDHPADKLLPGAYLGLDMVMGTNILLTLFKPPYNCTLMIDQSRKRGFIMFIDGHDKYLGTFPEWMVTYEENGSLVRLNDPGIPNDTEYMKLQLGQLSLLRWLDNATISGWQSVWSHPSSCKVSAFHCGAFGICTSTGTCKCIDGFRPTEPNEWELGHFGSGCSRITPSNCLGVVSTDLFVLLDNLQGLPYNPQDVMAATSEECRAICLSECYCAAYSYHSACKIWYSMLFNLTSADNPPYTEIYMRIGSPSKRRMHILVFVLIFGSIGVILFLLMLLLMYKRSSCVARQTKMEGFLAVYSYAQVKKATRNFSDKLGEGSFGSVFKGTIAGSTIVAVKKLKGLGHTEKQFRTEVQTVGMIQHNNLVRLLGFCTRGTRRLLVYEYMPNGSLDSHPFSETSRVLGWNLRHQIVVGIARGLAYLHEECRDSIIHCDIKPENILLDAEFCPKIADFGMAKLLGREFSAALTTIRGTIGYLAPEWISGQAITHKADVYSFGVVLFEIISGRRSTEKIRHGNHWYFPLYAAAKVNEGDVLCLLDDRIEGNASLKELDVACRVACWCIQDDEIHRPSMRKVIHMLEGVVDVELPPIPASFQNLMDDYDSDIYSVEV

SEQ ID NO: 7048 - protein, 166 aa, Oryza sativa
  UNSURE (1)..(166): unsure at all Xaa locations
  Clone ID: PAT_MRT4530_90460C.1.pep
  unsure (1)..(166): unsure at all Xaa locations
TKSSPTHPVELNEVKLIDGYYIMDPAKASGYXVDENTICIVAIPRSTLNGEYEDVKLLNDLLTKKNAETGWDTPIHVNAGSGWFIAPMLYPELKWDFRLXLANSMIISGHKYGLVYAGIGWCIWTSKEDLSEELMFHMNYLGADQPTXTLNLWKGCSHVIAHDYQL

SEQ ID NO: 7049 - protein, 541 aa, Oryza sativa
  Clone ID: PAT_MRT4530_90535C.1.pep
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 7050 - protein, 556 aa, Oryza sativa
  Clone ID: PAT_MRT4530_90537C.1.pep
MTTVASLSLLPHLLIKPSFRQWFQGSVILQTPYLKTCCIEGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAQMETLVNDRLLQDGGSSASTAECTSLAPSTSSASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 7051 - protein, 357 aa, Oryza sativa
  Clone ID: PAT_MRT4530_90587C.1.pep
MARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEAFTYNLWRERERERDFGGF

SEQ ID NO: 7052 - protein, 339 aa, Oryza sativa
  Clone ID: PAT_MRT4530_90589C.1.pep
MARRSSSRACAAMATAAVFALLAATATASGLVRVEHPAKSDGSLSLLVVGDWGRKGTYNQSRVAEQMGKVGEKLNIDFVISTGDNFYEDGLTGVDDQAFEESFTDIYTAKSLQKPWYLVLGNHDYRGDVLAQLSPVLRKIDQRFICMRSFIVNAEIVDFFFIDTTPFQLKYWTRPKDHHYDWRGVAPRQKYITNLLKDMDEAMKKSTAKWKIAVGHHTIRSVSDHGDTKELLQLLLPVLKVNGIDFYINGHDHCLEHISSRDSPIQYFTSGGGSKAWRGVLQPNSDKLQFFYDGQGFMSLQINQDQADFIFYDVSGNILYKWSKSKANYLQPSTYITEA

SEQ ID NO: 7053 - protein, 590 aa, Oryza sativa
  UNSURE (1)..(590): unsure at all Xaa locations
  Clone ID: PAT_MRT4530_90745C.1.pep
  unsure (1)..(590): unsure at all Xaa locations
MGSYAYKYCMCFTRKFRSPAADPPPDVRAAFLAAGGGDGGLRRFLAQAQGETPAEVDRILALLSGGGGGGGGGGIAARLVGPRPGPAPSLDDFFGFLFNADLNPXIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVKTFGNLLYIPSSDPINEFPSPESLMKKIIISTKPPEEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTRYKSVRLLMRFDFL

SEQ ID NO: 7054 - protein, 442 aa, Oryza sativa
  Clone ID: PAT_MRT4530_91041C.1.pep
MADTASPAAAREAMIEPASTPLLRRRGSYTRSMSHARDELGSFRSCLRWMCVEHSDGSSAVASWLVFTLLAVAVPAAARAALPRRAYDGQVQASLTLSAALAYLTLSRLVRRRGLRRLLYLDRLRHDSQDVRAGYTVELAGSFRLLACFVLPCFLADAAYKVYWYCANRPFPLWWSAAACALEMASWMYRTAMFFMACVLFRIICFLQILRMTGFARDFGQCADVADVLRQHRRIREQLRRISHRYRKFIVSCLLLVTASQFSALLAATRPHAQVNIATSGELALCSLSLVTGLLICLHSAAKITHKTQAITSVAAQWHADATINSQERDHENPRTPIKASSYLHAAGPVVPQPAPNASSSGDESEDETSPSDDGLDGTKIVSFHATHISFQKRQALVTYLENNRAGITVFGFVVDRTWLHALFMIEFSLVMWLLGKTIGIS

SEQ ID NO: 7055 - protein, 411 aa, Oryza sativa
  Clone ID: PAT_MRT4530_91259C.1.pep
MGGGGAGGDGEAWADQEQGNGGGRGGGGGEAKRSEIYTYEAGWHIYGMNWSVRRDKKYRLAIASLLEQHNNHVQVVQLDESSGDIAPVLTFDHPYPPTKTMFVPDPHSVRPDLLATSADHLRIWRIPSPDEAAAAAAASSNSGSVRCNGTASPDVELRCELNGNRNSDYCGPLTSFDWNDADPRRIGTSSIDTTCTIWDVEREAVDTQLIAHDKEVYDIAWGGAGVFASVSADGSVRVFDLRDKEHSTIIYESGSGGSSNSAGADGGAASPTPLVRLGWNKQDPRYMATIIMDSPKVVVLDIRYPTLPVVELHRHHSPVNAIAWAPHSSCHICTAGDDSQALIWDLSSMGTGSNNGGNGNGNAAAAAAAEGGLDPILAYTAGAEIEQLQWSATQPDWVAIAFSTKLQILRV

SEQ ID NO: 7056 - protein, 362 aa, Oryza sativa
  Clone ID: PAT_MRT4530_91530C.1.pep
MAHAAAATGALAPLHPLLRCTSRHLCASASPRAGLCLHHHRRRRRSSRRTKLAVRAMAPTLSSSSTAAAAPPGLKEGIAGLYDESSGVWESIWGEHMHHGFYDAGEAASMSDHRRAQIRMIEESLAFAAVPDDAEKKPKSVVDVGCGIGGSSRYLANKYGAQCYGITLSPVQAERGNALAAEQGLSDKVSFQVGDALEQPFPDGQFDLVWSMESGEHMPDKRQFVSELARVAAPGARIIIVTWCHRNLEPSEESLKPDELNLLKRICDAYYLPDWCSPSDYVKIAESLSLEDIRTADWSENVAPFWPAVIKSALTWKGLTSLLRSGWKTIRGAMVMPLMIEGYKKGLIKFTIITCRKPETTQ

SEQ ID NO: 7057 - protein, 510 aa, Oryza sativa
  Clone ID: PAT_MRT4530_91961C.1.pep
MATTDATIAHIMDEQEDIKVKASKCWNPIRPPATLLISNGRQISIQAPFSAREYLMESSRSPLSNGSNLITKFHPSQPQMKKQGATSPVMGLWACNFVWDPGPRIGLICTGKINNPRRGVSIAKAQHNVSFQRLLLSCAGPTVETNTVNSNSRFVPSSSLDANPVCDRTYPRNKSALIDRAMAVAVEEIVRRAGGCAVIDGGFATQLEALGADINDPLWSAACLITKPHLIKEVHMQYLEAGADVIISSSYQATIPGFLARGMLLEEAEGLLRRSIELALEARDEFWKSTLRKSKPVYNRALVAASIGSYGAYLADGSEYSGSYGEDITAEKLKDFHRRRLQVLASAGPDLIAFEAIPNKMEAQALVELLEEENIQVPSWICFSSVDGKNLCSGESFAECLQFLNASDKVTIVGVNCTPPQFIEGIIRELKKQTKKAIAVYPNSGEIWDGRAKRWLPAQCFGHKSFDALAKRWQEAGASLVGGCCRTTPSTIRAVSKVLKGKTSYSATQI

SEQ ID NO: 7058 - protein, 429 aa, Oryza sativa
  Clone ID: PAT_MRT4530_9221C.1.pep
MSSPPPAAAAAMAVDDADDDQLASMSTEDIVRATRLLDNETRVLKDELQRTNLEVESYKEKIKENQEKIKLNKQLPYLVGNIVEILEMNPEDEAEEDGANIDLDSQRKGKCVVLKTSTRQTIFLPVIGLVDPEKLKPGDLVGVNKDSYLILDTLPSEYDSRVKAMEVDEKPTEDYNDIGGLEKQIQELVEAIVLPMTHKDRFQKLGIRPPKGVLLYGPPGTGKTLMARACAAQTNATFLKLAGPQLVQMFIGDGAKLVRDAFQLAKEKSPCIIFIDEIDAIGTKRFDSEVSGDREVQRTMLELLNQLDGFSSDERIKVIAATNRADILDPALMRSGRLDRKIEFPHPSEEARARILQIHSRKMNVNPDVNFEELARSTDDFNGAQLKAVCVEAGMLALRRDATEVTHEDFNEGIIQVQAKKKSSLNYYA

SEQ ID NO: 7059 - protein, 623 aa, Oryza sativa
  Clone ID: PAT_MRT4530_92341C.1.pep
MEDWMPPPTPSPRTLMSSFLNEDFVSGSFSNIFSDHESNKPQDQFERNRELVDLSKEVPSQFARPAFQRDASLDHSLVSPTQRSNSHGGLAERRAARAGFSVPKIDTSRGGSSTVIRSPVAIPPGLSPTTLLESPVFLYNAMAQPSPTTGTLPFLMASNAKSTIPSATKMDEDCTFGNDTFSFQPHVGSRRPNFSAAEKGPNACHQNQSLSNIHQRESSLQSSFTAVKDITDEKNIKTKTSDSMFGDNHSSDEQDDETNQNGENSMPPPNHRSGVPLSHTNDPEVNVLENRGSQTCHNSASLWDNAKNDCLQDVQSEVIETRTAACLPVSTNCDTSIMESQDAVDVSSTLSNEEDDRATHGTASIECNGDGDETDSKRRKLDALTAATAAITTTSNIDMGAAASRGVREPRVVVQTTSEVDILDDGYRWRKYGQKVVKGNPNPRSYYKCTHQGCSVRKHVERASHDLKSVITTYEGKHNHEVPAARNSGHGSSGSGNAPSAPQSNGSQRRQEQGQASFSQFGGAAPFSSFVLPPRNQFGPSASNFPFGMVPPGMAIPMPSLGSLAPAKMAGHPSTMQGYQGLMIPEGEMKTEPMSQLGFPAVNQSSSSFQQMMNRPPSFGPQM

SEQ ID NO: 7060 - protein, 477 aa, Oryza sativa
  Clone ID: PAT_MRT4530_92556C.1.pep
MAVTADVKLEGLRAATDKLDQISENEKSGFISLVSRYLSGEAEQIEWSKIQTPTDEVVVPYDTLSAAPEDLNETKKLLDKLVVLKLNGGLGTTMGCTGPKSVIEVRNGFTFLDLIVIQIESLNKKYGCNVPLLLMNSFNTHDDTQKIVEKYSNSNIEIHTFNQSQYPRIVTEDFLPLPSKGKTGKDGWYPPGHGDVFPSLNNSGKLDTLLAQGKEYVFVANSDNLGAIVDIKFESLTITEILNHLIHNQNEYCMEVTPKTLADVKGGTLISYEGRVQLLEIAQVPDEHVNEFKSIEKFKIFNTNNLWVNLKAIKRLVEAEALKMEIIPNPKEVDGVKVLQLETAAGAAIRFFEKAIGINVPRSRFLPVKATSDLLLVQSDLYTLVDGFVIRNPARTNPSNPSIELGPEFKKVANFLARFKSIPSIVELDTLKVSGDVWFGSGVTLKGKVTITAKSGKLEIPDGAVLENKDINGPEDL

SEQ ID NO: 7061 - protein, 352 aa, Oryza sativa
  Clone ID: PAT_MRT4530_92598C.1.pep
MADSPSPRLDEEDAFGRDFNSSPSPTAPPARSGEKRPFGDLDDDDEDVFASKKGKTKVEESAPGAATGMILSLRESLQNCKDNLASCQVEREAAKSEVQKWHSAFQNIPAVPAGTNPDPVSVVSYLNNLKSSEESLKEQLEKAKKREAAFIVTFAKREQEIAELKSAVRDLKTQLRPPSMQTRRLLLDPAIHEEFTRLKNLVEEKEKKIKELQDNVAAVNFTPSSKHGKMLMAKCRTLQEENEEIGAMASEGKIHELGMKIAVLKTRNNELRNQFNELYKHMDGLTNDVERSNEMVAILQDELETKDVELRRLKEMLAQKEATDENKIPQENDVAGDDIVAAAESQPIKVET

SEQ ID NO: 7062 - protein, 459 aa, Oryza sativa
  Clone ID: PAT_MRT4530_92707C.1.pep
MVSYVGPSTARPTSGRAWAGYSDDAAAVRESRVASGGIEHGGGRPWPQDQRWYQHCHLQQEEEPWRCQIKAHTVLQGSDALSSIREWSRSHLVTMTGLVACAVLVVPSADAVDALKTCTCLLKECRIELAKCIANPSCAANVACLNTCNNRPDETECQIKCGDLFENTVVDEFNECAVSRKKCVPQKSDVGEFPVPDPSALVKNFNMADFNGKWYISSGLNPTFDTFDCQLHEFRVEGDKLIANLTWRIRTPDSGFFTRTAIQRFVQDPAQPAILYNHDNEFLHYQDDWYIISSKVENKEDDYIFVYYRGRNDAWDGYGGAVLYTRSKVVPESIVPELERAAKSVGRDFSTFIRTDNTCGPEPPLVERIEKTVEQGEKTIIREVQEIEGEIEGEVKELEEEEVTLFKRLTDGLMEVKQDLMNFFQGLSKEEMELLDQMNMEATEVEKVFSRALPIRKLR

SEQ ID NO: 7063 - protein, 446 aa, Oryza sativa
  Clone ID: PAT_MRT4530_92709C.1.pep
MAARPEVVSALSPPAGGGAMGGVRYHRCCPPRAYLWRKGDHLPLHHAKISARCSEIKAHTVLQGSDALSSIREWSRSHLVTMTGLVACAVLVVPSADAVDALKTCTCLLKECRIELAKCIANPSCAANVACLNTCNNRPDETECQIKCGDLFENTVVDEFNECAVSRKKCVPQKSDVGEFPVPDPSALVKNFNMADFNGKWYISSGLNPTFDTFDCQLHEFRVEGDKLIANLTWRIRTPDSGFFTRTAIQRFVQDPAQPAILYNHDNEFLHYQDDWYIISSKVENKEDDYIFVYYRGRNDAWDGYGGAVLYTRSKVVPESIVPELERAAKSVGRDFSTFIRTDNTCGPEPPLVERIEKTVEQGEKTIIREVQEIEGEIEGEVKELEEEEVTLFKRLTDGLMEVKQDLMNFFQGLSKEEMELLDQMNMEATEVEKVFSRALPIRKLR

SEQ ID NO: 7064 - protein, 533 aa, Oryza sativa
  Clone ID: PAT_MRT4530_93023C.1.pep
MDSSTVGAPGSSLHGVTGREPAFAFSTEVGGEDAAAASKFDLPVDSEHKAKTIRLLSFANPHMRTFHLSWISFFSCFVSTFAAAPLVPIIRDNLNLTKADIGNAGVASVSGSIFSRLAMGAICDMLGPRYGCAFLIMLAAPTVFCMSLIDSAAGYIAVRFLIGFSLATFVSCQYWMSTMFNSKIIGLVNGLAAGWGNMGGGATQLIMPLVYDVIRKCGATPFTAWRLAYFVPGTLHVVMGVLVLTLGQDLPDGNLRSLQKKGDVNRDSFSRVLWYAVTNYRTWIFVLLYGYSMGVELTTDNVIAEYFYDRFDLDLRVAGIIAASFGMANIVARPTGGLLSDLGARYFGMRARLWNIWILQTAGGAFCLLLGRASTLPTSVVCMVLFSFCAQAACGAIFGVIPFVSRRSLGIISGMTGAGGNFGAGLTQLLFFTSSRYSTGTGLEYMGIMIMACTLPVVLVHFPQWGSMFLPPNAGAEEEHYYGSEWSEQEKSKGLHGASLKFAENSRSERGRRNVINAAAAAATPPNNSPEHA

SEQ ID NO: 7065 - protein, 135 aa, Oryza sativa
  UNSURE (1)..(135): unsure at all Xaa locations
  Clone ID: PAT_MRT4530_93123C.1.pep
  unsure (1)..(135): unsure at all Xaa locations
LTHSNQYYLFHHKKDDEHDTGXVDSYGGGVYTSNTVTTDVFIGGQNEYKRYKMEEKXHTHKQHLVEAGALVDGAFIMYEKHEAKKDPENAHKHKIMEEIAFTDWFNAGRYTLHEHHEKNKDHTSAEESTGEKKHH

SEQ ID NO: 7066 - protein, 602 aa, Oryza sativa
  Clone ID: PAT_MRT4530_93287C.1.pep
MDTLFRLVSLQAASEQQQQQQQSASYNSRSTTSSGSRSSSHQTNASYSYYHHSSNSGGGGGGGGGYYYGGQQPPPSQYYYLEPYQEECGNAPHHQLYMDEDFSSSSSSRHFHHGARVQQQQPPASSTPTGTAPTPPLSTSSTAAGAGHGLFEAADLSFPPDLNLDFSSPASSSGGGTASSGAVGGGGGGRWASQLLLECARSVAARDSQRVQQLMWMLNELASPYGDVEQKLASYFLQGLFARLTASGPRTLRTLAAASDRNTSFDSTRRTALRFQELSPWSSFGHVAANGAILESFLEVAAAASSETQRFHILDLSNTFCTQWPTLLEALATRSADETPHLSITTVVSAAPSAPTAAVQRVMREIGQRMEKFARLMGVPFRFRAVHHSGDLAELDLDALDLREGGATTALAVNCVNSLRGVVPGRARRRDAFAASLRRLDPRVVTVVEEEADLVASDPDASSATEEGGDTEAAFLKVFGEGLRFFSAYMDSLEESFPKTSNERLALERGAGRAIVDLVSCPASESMERRETAASWARRMRSAGFSPVAFSEDVADDVRSLLRRYREGWSMREAGTDDSAAGAGVFLAWKEQPLVWASAWRP

SEQ ID NO: 7067 - protein, 497 aa, Oryza sativa
  UNSURE (1)..(497): unsure at all Xaa locations
  Clone ID: PAT_MRT4530_9330C.1.pep
  unsure (1)..(497): unsure at all Xaa locations
MREGNVTHHEYMQVGKGRDVGMNQISSFEAKVANGNGEQTLSRDIYRLGRRFDFYRMLSFYFTTVGFYFSSMVTVLTVYVFLYGRLYLVMSGLERSILLDPRIEQNIKPLENALASQSFFQLGLLLVLPMVMEVGLEKGFRTALGEFVIMQLQLASVFFTFQLGTKTHYYGRTILHGGAKYRPTGRGFVVYHAKFADNYRMYSRSHFVKGLELLILLVVYLVYGSSYRSSSMYLFVTFSIWFLVASWLFAPFIFNPSCFEWQKTVDDWTDWRKWMGNRGGIGMSVDQSWEAWWISEQEHLRKTSIRSLLLEIILSLRFLIYQYGIVYHLNIARRSKSILVYGLSWLVMLSVLVVLKMVSIGRQKFGTDLQLMFRILKGLLFLGFVSVMAVLFVVCNLTISDVFASILGFMPTGWCILXDWAGMFAVGEEGNAVGFHHGAREVVREPDGTRPLPPHRPLVMVPLRVRVPDTTALQPGLQPWPPDLKDPRRAKGHWRGM

SEQ ID NO: 7068 - protein, 629 aa, Oryza sativa
  UNSURE (1)..(629): unsure at all Xaa locations
  Clone ID: PAT_MRT4530_94258C.1.pep
  unsure (1)..(629): unsure at all Xaa locations
MAAPSAATRRKLQRKFKLRGFTLKVDALEEAAAFLARFPDAEDDALDLLLDELDKEPLQSSILDRDAVRRVVALLVEADEAVDAASPAATSARSALRVVDSFVVPRFHYDPIKKVFYELAIHGEAGDKAALYRDRYQVLLQRLARDIYFSKPAFDTVMTEDDNCEVNTCGFPPLEDREASLSMLMGLDFFGGGPSKALPRCALPKYLTEELQKHIPNAIFVSNPCSTHGHAVDCRLVHYTRSIADAQPQDVPQWSWAERFAIGRPVVDSAPYGVGRSAQWPEDGPTMGTYWCRRGRRYAHVQVRRGYPDFVFEFDRLQPSDVIWEPYTEEAVAARAPLGLSSLCTRDQAYWLTILPMVFDIFVEPHCPQRVMRQFGLRQVLATEEVINELFLHTEENYRDYLRWYLPRTHARVTFTPDAPEPHVAAVTDAYPTHRDRDYFVGADAARDISANITAVQVRLNRGLHLTDVEQRVTFDRMQEKMRAVMRVFSCRSAVDVVPPAGPDLVCLRAPLASEQCDLQHRNSSAFERVHSHDRRFRELRRGIRQHFRRVRHLFERVRQLFLSRSVDPSSTRRDLRYWGLFVSRRXGGAPEAHTQEQPEVTPVQAGRVGRAIPPDRLTYSQGHVRAQA

SEQ ID NO: 7069 - protein, 97 aa, Oryza sativa
  Clone ID: PAT_MRT4530_94515C.1.pep
VNTSTPAIQKCMAYFPQNEIEKDFYYLFSLATIFNTCILESWILIRGIKDIILVLHRGMKYLHLWTKRIKNRPCICGQRIIPWKAIQKLKHMVYVSG

SEQ ID NO: 7070 - protein, 544 aa, Oryza sativa
  Clone ID: PAT_MRT4530_94553C.1.pep
MCADCPSTVAALGKKAETLKPAQVLPTTSGPVLFKHREAKPTGGYCIHVICSKFRCPLLYGKAATTREGGEVEEGAMGGAEDAPRAAAANGHGNGATVEEKLDELRRLLGKADGDPLRIVGVGAGAWGSVFCALMQDAYGHLRDKVQVRIWRRPGRAVDRATAEHLFEVINAREDVLRRLIRRCAYLKYVEGRLGDRTLYADEILRDGFCLNMIDTPLCPLKVVTNLQEAVWDADIVINGLPSTDTREVFGEIGRYWKERITAPIILSLAKGIEASLDPLPRIITPTQMISNATGVPLENILYLGGPNIASEIYNKEYANARICGADKWRKPLAKFLRQPHFIVWDNSDLITHEVMGGLKNVYAIGAGMVAALTNESATSKSVYFALCTSEMIYITHLLEEEPEKLAGPLLADTYVTLLKGRNAWYGQKLAKGELTLEMGDSIKGKGTIQGVSAVHAFYELLSQSSLSVTHPEVKKLVAPVELCPILKALYKILIKRELATDSILQAIRDESMYDPRERIEMAQRQCLYRPSLLGLPKVDITQA

SEQ ID NO: 7071 - protein, 676 aa, Oryza sativa
  Clone ID: PAT_MRT4530_94738C.1.pep
MAPTSMSLAAKTPLPFSTLPSSGVAQRPVSVTASLEHKTNDARRKFLKLALGNLGVGLPTLLGAKRALAEEQGVSSSRMSYSRFLEYLDKDRVKKVDLFENGTIAIVEAISPELGNRVQRVRVQLPGLSQELLQKLREKNIDFAAHSNQEDSGSLLFNLIGNLAFPLILIGGLFLLSRRAQGGLGGPNGPGFPLGFGQSRAKFQMEPNTGVTFDDVAGVDEAKQDFMEVVEFLKKPERFTAVGARIPKGVLLVGPPGTGKTLLAKAIAGEAGVPFFSISGSEFVEMFVGVGASRVRDLFKKAKENAPCIVFVDEIDAVGRQRGTGIGGGNDEREQTLNQLLTEMDGFEGNTGIIVIAATNRADILDSALLRPGRFDRQVSVDVPDVRGRTEILKVHGSNKKFDTDVSLEVIAMRTPGFSGADLANLLNEAAILAGRRGRTAISSKEIDDSIDRIVAGMEGTVMTDGKSKSLVAYHEVGHAICGTLTPGHDPVQKVTLIPRGQARGLTWFIPMDDPTLISRQQLFARIVGGLGGRAAEEIIFGEPEVTTGAAGDLQQITGLAKQMVVTFGMSDIGPWSLMDSGAQSGDVIMRMMARNSMSEKLAEDIDTAVKRLSDEAYEIALSQIRSNREAMDKIVEVLLEKETLSGDEFRAILSEFTEIPVENRVPPATPAALPA

SEQ ID NO: 7072 - protein, 233 aa, Oryza sativa
  Clone ID: PAT_MRT4530_94829C.1.pep
MAANVGESTSSGTNGDAAGGSFECNICFELPQEPIVTLCGHLFCWPCIYRWLHIHAHSPECPVCKAVVEEDKLVPLYGRGKDRVDPRSKNIPEADIPNRPTGQRPATAPQADPNNNFAHANPNANANPWFMGTGVPLANARWGNYAFSAAFGGLFPMLSFQVHGFPDANPYAQPAGFHYGYGHGHGFHGGHMGHAAHGVPRQGPLEQPQQADIYLKALLIMVGFLVVASLLAF

SEQ ID NO: 7073 - protein, 996 aa, Oryza sativa
  UNSURE (1)..(996): unsure at all Xaa locations
  Clone ID: PAT_MRT4530_94961C.1.pep
  unsure (1)..(996): unsure at all Xaa locations
MGCSSSVPARSTGGLNNISNDNSATDSKDLRAKLVLLGDSGVGKSCIVLRFVRGQFDPTSKVTVGASFLSQTLALEDSTIVKFEIWDTAGQERGAAAAVVVYDITSPESFSKAQYWVKELQKHGSPDIIMVLVGNKADLHENRHVSSQEAQEYAEKNNMVFIETSAKTADNINQVFEVTVFALGFRARMRPVLVRRGLGKGKKDFSTAILERKKSPNRLVVDEATNDDNSVIGMHPDTMEKLQLFRGDTVLLKGKKRKDTICIVLADDTCEEPKIRMNKVVRKNLRVRLGDVVSVHQCPDVKYGKRVHILPIDDTVEGITGNLFDAFLKPYFLEAYRPLRKGDLFLVRGGMRSVEFKVIETDPAEYCIVAPDTEIFCDGEPIKREDEERLDEVGYDDVXGGVRKQMAQIRELVELPLRHPQLFKSIGVKPPKGILLYGPPGSGKTLIARAVANETGAFFFLINGPEIMSKLAGESESNLRKAFEEAEKNAPSIIFIDEIDSIAPKREKTHGEVERRIVSQLLTLMDGLKARSHVIVMGATNRPNSIDPALRRFGRFDREIDIGVPDEVGRLEVLRIHTKNMKLAEDVDLEHIAKDTHGYVGADLAALCTEAALQCIREKMDIIDLEDETIDAEILNSMAVTNDHFKTALGTSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDDQSRLQIFKACLRKSPVAKDVDLNALAKYTQGFSGADITEICQRACKYAIRENIEKDIEMEKRRKDNPEAMEEDEVDDIAEIKAAHFEESMKYARRSVSDADIRKYQAFAQTLQQSRGFGTEFRFADQPASGAGAAADPFASAAAAADDDDLYS

SEQ ID NO: 7074 - protein, 193 aa, Oryza sativa
  Clone ID: PAT_MRT4530_95069C.1.pep
MSLSTIARRLCCSRPTSGGRLSAVWAHLYSTEAAKDTGAKKYKYPEVYDPYGPMSPPSQKVVDLADRIAALPPEEIKQIAPALLLRLNQPPPQAISGQGFSFSPQGGGGAAGAAKAEEKKAEKTVFDVKLEKFDAAAKIKIIKEIRTFTDLGLKEAKELVEKAPVILKQSLTKEEAEAIIEKIKVAGGVAVME

SEQ ID NO: 7075 - protein, 1001 aa, Oryza sativa
  UNSURE (1)..(1001): unsure at all Xaa locations
  Clone ID: PAT_MRT4530_95078C.1.pep
  unsure (1)..(1001): unsure at all Xaa locations
RAAAGATGPRPAPGYTAAXAVIEKKEDGPGCRCGHTLTXVPAVGEEGTPGYIXPRLILFWGATALEGNCYTPPSSGGSAGIRLAGATADVHCYDVLRGSWSALVWRASPHLLALKVAYPLRVHLVRGCHQADGGIGPAGLSAEDLHVLDLTQQRPRWHRVVVQGPGPGSRYGHVMALVGQRFLLTIGGNDGKRPLADVWALDTAAKPYVLRKLEPEGEGAPPCMYATGSARCDGLLLLFGGRDANSVVFVNARLHVLGGPLGGGRMVEDSSNVAVLDPAAGVXCDTKSVITTPRTGRDSADAAGGGASVELTRRCRHAAAAVGDMIYVYGGLRGGVLLDDLLVAEDLAAAETTNAATEAAALAXAVIDNPEXPVRYAYNDEQTRXTATITSPDGAVVLGNPVAAPVNGDMYTDISPENAVIQGQRRMSKGVDYLVEASAAVAEAISDTXAAVIAQQVNGEAEHSPDRVKSMVATANVKQNAILIDPDYLLSNKLPRGGRLHHRAVVVAAETGGALGGMVRQLSIDQFENEGRRVSYGTPENATAARKLLDRQMSINSVPKXYVVRRQHSLETITLLLALKVEYPLNVHLIRGNHEAADINALFGFRIECIERMGERDGIWTWHRMNRLFNWLPLAALIEKKIICMHGGIGRSINHVEQIENLQRPITMEAGSVVLMDLLWSDPTENDSVEGLRPNARGPGLVTFGPDRVMEFCNNNDLQLIVRAHECVMDGFERFAQGTANNAGAILVLGRDLVVVPKLIHPLPPAITSPETSPEHHLEDTWMQILGFFCAGVVLNQFGLIRNLTDVKLLSEWGILFLLFEMGLELSLSRLKALARYAFGMGLPQVLLSTLAFTAFELPPNGAIGTKILQFLFDSRPDLVNIRSVDEAIVIGAALSLSSSAFVLQLLAEKGELPTRFGSATLGILLLQDIAVVPLLVILPVLESQNVVEQSVWPMLLAESLKALGGLGLLFASRLDWLKRIVLLYAVFFPLVFFFPFFLGS

SEQ ID NO: 7076 - protein, 292 aa, Oryza sativa
  Clone ID: PAT_MRT4530_95103C.1.pep
MEQYEKVEKIGEGTYGVVYKGKHRHTNETIALKKIRLEQEDEGVPSTAIREISLLKEMQHRNIVRLQDVVHKEKCIYLVFEYLDLDLKKHMDSSPDFKNHRIVKSFLYQILRGIAYCHSHRVLHRDLKPQNLLIDRRTNSLKLADFGLARAFGIPVRTFTHEVVTLWYRAPEILLGARHYSTPVDMWSVGCIFAEMVNQKPLFPGDSEIDELFKIFSIMGTPNEETWPGVASLPDYISTFPKWPSVDLATVVPTLDSSGLDLLSKMLRLDPSKRINARAALEHEYFKDLEVA

SEQ ID NO: 7077 - protein, 80 aa, Oryza sativa
  UNSURE (1)..(80): unsure at all Xaa locations
  Clone ID: PAT_MRT4530_95268C.1.pep
  unsure (1)..(80): unsure at all Xaa locations
NSGGTPHYSSSLSYDDXSASSLMWDDSFSSTPRLLDLLFLFHGRVGAQVXVILTDLVNAGGERPWDQDRLKPLSHEVPXL

SEQ ID NO: 7078 - protein, 356 aa, Oryza sativa
  Clone ID: PAT_MRT4530_95963C.1.pep
MGVTGEKFQLGTVGALSLSVVSSVSIVICNKALMSSLGFNFATTLTSWHLLVTFCSLHVALCMKLFEHKPFDARTVMGFGVLNGISIGLLNLSLGFNSVGFYQMTKLAIIPCTVILETLFFRKKFSRNIQLSLSVLLFGVGVATVTDLQLNAVGSVLSLLAIITTCIAQIMTNTIQKKFKVSSTQLLYQSCPYQALTLFIVGPFLDGFLTNQNVFAFDYTSQVVFFIVLSCLISVSVNFSTFLVIGKTSPVTYQVLGHLKTCLVLAFGYVLLHDPFSWRNILGILIAVIGMVSYSYFCTKEAPPKPTEASPQLNQVKESESDPLISDSLSTAENGGNAGDDEALKVPMWSSKYSKA

SEQ ID NO: 7079 - protein, 930 aa, Oryza sativa
  UNSURE (1)..(930): unsure at all Xaa locations
  Clone ID: PAT_MRT4530_96163C.1.pep
  unsure (1)..(930): unsure at all Xaa locations
MPLSARGWVCVMDAFSFMASQPPAAVEARLADLCKELGVDEGVAGEAAAVLEEGKGALLASPSFGSKSPEDAEKLCFAFVLYCVSKLKETKAGSSGVRLWEILKGCKLKYDDFFKESQRLASRIDQVLGSRYGSDWEARLELKQLENLVNLLADASRFYCKAFNELFLSPSTDQEPGSTTNIPDYIRFGWLLFLILRSKSPELFKDLVSCIHGLVAILAILLIHVPANXPMPSLDGIVARQSIHPDXLATYSLIKKVLMLAQMASCYPSXSPKRLCTESRNSLVEHNSQTPPPKQSQTGLSILKAKYHPLQATFASPTVSNPVSGNEKCAVVGVQIFFSKILKLAAIRIRNLCERLRHEELTVSVYNIFKQILDQQTALFFNRHVDQIILCCLYGVAMGSQLSLTXADAFDIPWAEARKMEASKLYYRVLEAICRAESQNNNVNNLTPLLSNERFHRCLIACSAELVLATHKTVIMMFPAVLESTGLTAFDLSKIIENFVRHEETLPRELKRHLNSLEEQLLESMSWEKGSSLYNSLVVARPSLSTEINSLGLLAEPMPSLDGIVARQSIHPDGLPPTPSKRWPSAGPDGNCYPQSPKRLCTESRNSLVERNSQTPPPKQSQTGLSILKAKYHPLQATFASPTVSNPVSGNEKCAVVGVQIFFSKILKLAAIRIRNLCERLRHEELTVSVYNIFKQILDQQTALFFNRHVDQIILCCLYGVAKVSQLSLTFKEIVNNYKREPQCKPEVFRSIFVGSTNRNGGFGSRHVDIIVFYNQVFVPTVKPLLVALMPSSTRPEDKRNTNSQIPGSPKSSPFSNLPDMSPKKVSSSHNVYVSPLRQTKMDALLSPSSRSFYACIGESTQAFQSPSKDLAAINSRLNYPTRRINTRINFDMVSDSVVAGSLGQPNGGSASSDPAAAFSPLSKKSKTDS

SEQ ID NO: 7080 - protein, 576 aa, Oryza sativa
  UNSURE (1)..(576): unsure at all Xaa locations
  Clone ID: PAT_MRT4530_96281C.1.pep
  unsure (1)..(576): unsure at all Xaa locations
DFFSEYGDANRYKIQEVIGKGSYRCXICSAIDQHTGDKVAIKKIHNIFEHLSDAARILREIKLLRLLRHPDILEIKHXIMLPPSRRDFKDIYVVFELMDTDLHQVIKANDDLTKEHYQFFLYLVLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGLSELTAPLTTEMYLVNGYRLTA

SEQ ID NO: 7081 - protein, 98 aa, Oryza sativa
  Clone ID: PAT_MRT4530_96382C.1.pep
KSMTDIADKNNKWASYAGPGGWNDPDMLEVGNGGMTFAEYRAHFSIWALMKAPLLIGCDVRNMTKETMEILSNKEVIQVNQDPLGVQGRRILGQGKNG

SEQ ID NO: 7082 - protein, 417 aa, Oryza sativa
  Clone ID: PAT_MRT4530_9638C.1.pep
MAIGHHHPRGAQAQRTRAPPRLVCFGPPLAPPAEALTLRLLILLLLLRQEQNQTCHEGFDNLGVRDEMIFSVSLFGSSHQSIHKLYRKCWSSNSHSTLNVLSLAKTVGQSMRMKRIRVKPHATDLKNRPQAHEDNVFYKLVYRLPENLSWLLASPEMARRPPSKKKLKKEEMVSSNQFGVILEWEGVVVEDDDPDLEPRVWYVLSLEEAKSFPPDAVLKEIEGMRTDQAILEVLHWSEDPQEVQRLAARKEVIYKTLRGRFYQLRPGVLDFLNTLVDFDIPIAITTPRPRLSLEEGIKAVGLQGYFDAIVAAEDFCRGKPEGEMFEVTAGQLGLEPDVCLVLGNSNSTIESAHTAGMRCVAVASRYPAYELQAANHVVRWLDQLSVADLQRIANGEILGLRGRRSDMDMDMEIVIEE

SEQ ID NO: 7083 - protein, 446 aa, Oryza sativa
  Clone ID: PAT_MRT4530_96586C.1.pep
MAPPSAMNTSRAEEKAIDDWLPITSSRNAKWWYSAFHNVTAMVGAGVLSLPFAMSELGWGPGVAAMIMSWVITLYTLWQMVEMHECVPGRRFDRYHELGQHAFGDKLGLWIVVPQQLVVEVGVCIVYMVTGGKSLKKFHDLVAPPSAPPIRTSYFIVIFGCLHLVLSQLPNFNSISGVSLAAAVMSLSYSTIAWAASLHHHNHNNGAAAGGVDYSLTAATPAGRTFNFLSALGDVAFAYAGHNVVLEIQATIPSTPERPSKGPMWRGVVLAYGVVAVCYLPVAFAGYYVFGNAVDDNVLITLERPAWLIAAANMFVVVHVVGSYQIYAMPVFDMLETFLVKKLRFKPGMPLRLIARSLYVLFTMFVAIAVPFFGGLLGFFGGFAFAPTTYFLPCIMWLSIMKPKRFGLSWCINWFCIIIGVLLSVFAPIGGLRSIIVNAQSYKFFS

SEQ ID NO: 7084 - protein, 447 aa, Oryza sativa
  Clone ID: PAT_MRT4530_96587C.1.pep
MGTQVADNYPPAKDGRSAQEKAIDDWLPITSSRNAKWWYSAFHNVTAMVGAGVLSLPYAMSELGWGPGIAVLILSWIITLYTLWQMVEMHEMVPGKRFDRYHELGQHAFGEKLGLWIVVPQQLVVEVGVNIVYMVTGGKSLKKFHDVLCEGHGCKNIKLTYFIMIFASVHFVLSQLPNFNSISGVSLAAAVMSLSYSTIAWGASVDKGKVADVDYHLRATTSTGKVFGFFSALGDVAFAYAGHNVVLEIQATIPSTPEKPSKKPMWKGVVVAYIIVALCYFPVALVGYWAFGNHVDDNILITLSRPKWLIALANMMVVIHVIGSYQIYAMPVFDMIETVLVKKLRFPPGLTLRLIARTLYVAFTMFIAITFPFFGGLLGFFGGFAFAPTTYFLPCIMWLAIYKPRRFSLSWFTNWICIILGVMLMILSPIGGLRQIIIDAKTYKFYS

SEQ ID NO: 7085 - protein, 191 aa, Oryza sativa
  UNSURE (1)..(191): unsure at all Xaa locations
  Clone ID: PAT_MRT4530_97109C.1.pep
  unsure (1)..(191): unsure at all Xaa locations
MVVASGGGRNAWAKEMTIRRRITSIFNKTREHFPSLKDYNDYLEEVEDMTFNLIEGIDVEVIEAKIARYQQENAEQIYLSRAKRAEDLAAALKASRMNPGKAGANDXRLLEALRALVVAREFRKASMRLLLFPPRPTGMAPQPIGGSSVPLQGDDEETMRLRAESGARAGGWSIEMCKRRALQEAFSTIFV

SEQ ID NO: 7086 - protein, 671 aa, Oryza sativa
  Clone ID: PAT_MRT4530_9713C.1.pep
MAMALGRAAKSPAEQRRGAGARQRSIGEGFGVGQQTAAATRRGGGGEEDETVRGGGGGGGGDGGDEEVGWVRPPGGLAGEDKAAAWKGRAPAIVVSDAVEVDFPVIYVNAAFEAATGYRADEVLGRNWLSSGGKVYLLTRKTIRFLQFRDPRAQRRHPLVDPMVVSEIRRCLNEGIEFQGELLNFRKDGAPLYNRLRLIPMHGDDGFVTHVIGIQLFSEANIDLSNVSYPVYKQQSNHRPNIQEINPASHEHIPKIQSSEYCCILQLSDEVLAHNILSRLSPRDVASIGSVCTRMHELTKNDHLRKMVCQNAWGRDVTVRLEMSTKMLGWGRLARELTTLEAASWRKFTVGGRVEPSRCNFSACAVGNRLVLFGGEGVNMQPMDDTFVLNLESAKPEWRRVKVSASPPGRWGHTLSWLNGSWLVVFGGCGQQGLLNDVFVLDLDAKQPTWREVASEGPPLPRSWHSSCTLDGSKLVVSGGCTESGVLLSDTFLLDLTKEKPAWKEIPTSWSPPSRLGHTLSVFGKTKLFMFGGLAKSGSLRLRSCDAYTMDAGEDSPQWRQLATTGFPSIGPPPRLDHVAVSLPCGRIIIFGGSIAGLHSPSQLFLLDPAEEKPTWRILNVPGQPPKFAWGHSTCVVGGTRVLVLGGHTGEEWILNELHELCLASRPDEDE

SEQ ID NO: 7087 - protein, 417 aa, Oryza sativa
  Clone ID: PAT_MRT4530_97364C.1.pep
MMMNVPSAAAASSCDDFGYNATPPPPPSLLPIMDQDGGGGSIQRDHHHHHNHQQLGYNLEPSSLALLPPSNAAAAAAHHATIAHASPHDLLQFYPTSHYLAAAGGAGGGGNPYSHFTAAAAAGSTFQSYYQQPPQAAPEYYFPTLVSSAEENMASFAATQLGLNLGYRTYFPPRGGYTYGHHPPRCQAEGCKADLSSAKRYHRRHKVCEHHSKAPVVVTAGGLHQRFCQQCSRFHLLDEFDDAKKSCRKRLADHNRRRRKSKPSDGEHSGEKRRAQANKSAATKDKAGSSSKNAGIGDGFETQLLGGAHMSKDQDQAMDLGEVVKEAVDPKGKASMQQQQQQAHHGIHQQSHQQHGFPFPSSSGSCLFPQSQGAVSSTDTSNIAQVQEPSLAFHQQHHQHSNILQLGQAMFDLDFDH

SEQ ID NO: 7088 - protein, 114 aa, Oryza sativa
  Clone ID: PAT_MRT4530_97559C.1.pep
MPRATSDAKLLIQSLGKAYAATPTNLKIIDLYVVFAVATALIQVVYMGIVGSFPFNSFLSGVLSCIGTAVLAVCLRIQVNKDNKEFKDLPPERAFADFVLCNLVLHLVIMNFLG

SEQ ID NO: 7089 - protein, 103 aa, Oryza sativa
  UNSURE (1)..(103): unsure at all Xaa locations
  Clone ID: PAT_MRT4530_97655C.1.pep
  unsure (1)..(103): unsure at all Xaa locations
VENAIMVKLPKRAVSYKNDKLAXDPLMLLFKTALLTSGLSSEDPNTFCTXIQRMLKLVLSIYQDXSTKADTDMPTMEDYPCESKMDEVDLTGWTHGCHSGHFS

SEQ ID NO: 7090 - protein, 118 aa, Oryza sativa
  UNSURE (1)..(118): unsure at all Xaa locations
  Clone ID: PAT_MRT4530_97805C.1.pep
  unsure (1)..(118): unsure at all Xaa locations
MADDKHQDHLLHHKKDHXPATGVDSYGEGVYTWETVTTEVAAGGQDKYERYKKEEKQHKHXQDLGEADALADGASAHDEKHEANKDPVKAHRHMITEDIAATGAAGAGGYTLDEHHEK

SEQ ID NO: 7091 - protein, 475 aa, Oryza sativa
  Clone ID: PAT_MRT4530_97968C.1.pep
MVGSYAAGGGRGAAVAAVAEGKLDELRRRMGKADGDLLRIVGVGGGAWGSAFCALLQDAYGRHRDKAQVRVWRRPGRAVDRATAEHLFEVINSREDVLRRLIRRCAYLKYVEARLGDRTLYADEILRDGFCLNMVDTPLCPLKVVTNLQEAVWDADIVINGLPSTETREVFGEIGRYWKERIRPPVIISLAKGIEASIDPVPRIITPTQMISNATGVPLENILYLGGPNIASEIYNKEYANARICGADKWRKPLAKFLRQPHFIVWDNSDLITHEVMGGLKNIYAIGAGMVAALTNESATSKSVYFSLCTSEMIYITHLLAEDPEKLAGPLLADTYVTLLKGRNAWYGQKLAKGELTLEMGDSIKGKGTIQGVSAVHAFYELLSQSSLSVTHPEVKKLVAPVELCPILKTLYKILIKRLKFFAHFTCRELATDSILQAIRDESMYDPRERIEMSQRQCLYRPSLLGLPKVDITQA

SEQ ID NO: 7092 - protein, 302 aa, Oryza sativa
  Clone ID: PAT_MRT4530_98306C.1.pep
MGAMDVQLESTAVQHGQAKINVEEHALVSLLSDEKYATEKTEDVDPDDYEKLEEGIMQYGCAHYRRRCRIRAPCCNEIFDCRHCHNETKNSIKIDAVKRHELPRHEVQQVICSLCGTEQEVRQVCISCGVCMGKYFCEVCKLFDDDVSKQQYHCNGCGICRIGGKENFFHCSKCGCCYSIVLKNSHACVEGAMHHDCPICFEYLFESTNDVSVLPCGHTIHVKCLREMEEHCQFACPLCSKSVCDMSKAWERLDEELATISDTCDNKMVRILCNDCGATSEVQFHLIAHKCQKCKSYNTRQI

SEQ ID NO: 7093 - protein, 231 aa, Oryza sativa
  Clone ID: PAT_MRT4530_98621C.1.pep
MALRCVASRKTLAAAALPLAAAAAARGVTTVALPDLPYDYGALEPAISGEIMRLHHQKHHATYVANYNKALEQLDAAVAKGDAPAIVHLQSAIKFNGGGHVNHSIFWNNLKPISEGGGEPPHAKLGWAIDEDFGSFEALVKKMSAEGAALQGSGWVWLALDKEAKKLSVETTANQDPLVTKGANLVPLLGIDVWEHAYYLQYKNVRPDYLSNIWKVMNWKYAGEVYENATA

SEQ ID NO: 7094 - protein, 779 aa, Oryza sativa
  Clone ID: PAT_MRT4530_98682C.1.pep
MAGIAALANRQSVLPFSYASPLLMLSTGSSLFVEEHKQTFLTSPNADFSCGFYEVGGNAFSFSIWFTNSKNRTVVWSANPKSPVNGHGSKVTLNHEGNLVLADVNGTANWDSKTSSGKGTTAVLLDTGNLVIRDSTGTKLWQSFWAPTDTLLPLQPLTKGTRLVSGYFNLYFDNDNVLRLMYDGPEISSIYWPSPDYSVFDIGRTSYNGSRNAILDTEGHFLSSDKLDIKAADWGAGINRRLTLDYDGNLRMYSLNASDGSWKVSWQAIAKLCDVHGLCGENGICEFLPSFKCSCPPGYEMRDPTNWSRGCRPLFSKNCSKIEEYEFFKLAQTDFYGFDLIINQSISLKECKKTCLDICSCSAVTYKTGSGTCYIKYVLFNGYSSTNFPGDNYIKLPKNMVSKQSDLSCNPTKEIVLGSSSMYGMNDANKNYATYYVFAAVLGALVLIFTGTSWWFLYSKHNIPMSMEAGYRMVTSQFRMFTYRELREATGKFKEEIGRGASGIVYRGVLEDKRVIAVKRLMNISHGEEEFWAEMSIIGRINHMNLVRMWGFCSEGQQKLLVYEYVDNESLDKYLFGDVSAERLLAWSQRFKIALGTARGLAYLHHECLEWVVHCDVKPENILLTRDFEVKIADFGLAKLSKRDSTSLNFTHMRGTMGYMAPEWALNSPINAKVDVYSYGVVLLEIVTGSRISSGIKVDGREVELRDFVQVMKHILATGDVKDVIDTRLNGHFNSEQAKVMVEVAISCLEERNSRPTMDEIAKAFLACDDEDNHPAYSW

SEQ ID NO: 7095 - protein, 1846 aa, Oryza sativa
  Clone ID: PAT_MRT4530_98926C.1.pep
MAAPGGARRPDFSSAASPSPSPAGAAGRRLLRTQTVGNLGESIFDSEVVPSSLVEIAPILRVANEVEATNPRVAYLCRFYAFEKAHRLDPTSNGRGVRQFKTALLQRLERENDPTLKGRVHQSDAREMQRFYREYYKKYIQALQNAADKADRALLTKAYQTAAVLFEVLKAVNVSQSVEVDQAILDTHNKVEEKKKLYVPYNILPLDPESTYQPIMQYPEIQAAVNALRNIRGLPWPKEHEKKPDEKKTGKDLLDWLQAMFGFQKDNVSNQREHLILLLANVHIRQSPKTEQQAKLDDRALDAVMKKLFKNYKKWCKYLGRKSSLWLPTIQQEVQQRKLLYMGLYLLIWGEAANLRFMPECLCYIYHHIMEALLNSINYIEMAFELYGMLAGNVSPMTGENVKPAYGGDEEAFLMKVVTPIYKVIEKEAERSKTIKSKHSHWRNYDDLNEYFWSVDCFRLGWPMRADADFFKTPEDAYPSRLNGIIGMDYISSLVLQCNAKKKKYLLGVLILWVPISRLVANAGEQIRRRFLESSNVKVITFIMWWSQPRLFVGRGMHEGAFSLFKYTMFWVLLLAMKLTIKPLVQPTKDIMKEPIRDFQWHEFFPRANNNIGVVIALWAPIILVYFMDTQIWYALFSTLIGGIYGAYRRLGEIRTLGMLRSRFESLPEAFNEHLIPSDSHKSKGLRAAFTGKPSKTSGDEQEKEKIAARFAQMWNLIITSFREEDLIDNREMDLLLVPYCKDRELNIFQWPPFLLASKIPIALDMAADSGGKDRDLKKRMGSDPYFSYAIRECYGSFKNIINTLVFGQREKIVIQQIFTIVDEHIEGGSLIKDLNMRSLPALSKKFIELLELLQKNKEEDLGQVVILFQDMLEVVTRDIMDEQDQLGGLLDSVHGGNRKHEGMTSLDQQDQLFTKAIRFPVEESNAWTEKIKRLHLLLTVKESAMDVPTNLDARRRISFFANSLFMEMPNAPKVRHMLPFSVLTPYYKEDVLFSSHNLEEPNEDGVSILFYLQKIYPDEWKNFLDRVDRKSEEELREDETLEEELRLWASYRGQTLTRTVRGMMYYRKALELQAFLDMAKDDDLMEGYRATELMSEDSQLMTQCKAIADMKFTYVVSCQQYGIQKRSGEAFGAHMIVLSATVQSSVFLYPSLRVAYIDEVEAPSQDRNKKTDKVYYSALVKASVTKPNEPGQSLDQVIYKIKLPGNAILGEGKPENQNHAIIFTRGECLQTIDMNQEHYMEEALKMRNLLDEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQIALFEAKIANGNGEQTLSRDIYRLGHRFDFFRMLSCYYTTIGFYFSTMITVWTVYVFLYGRLYLVLSGLDQALATGKKFVHNAPLQVALASESFVQLGFLMALPMMMEIGLERGFRTALSDFVLMQLQLASVFFTFSLGTKTHYYGRTLLHGGAEYRATGRGFVVFHAKFADNYRLYSRSHFVKGIELMILLVVYEIFGQSYRGAITYIFITVSMWFMVGTWLFAPFLFNPSGFEWQKIVDDWTDWNKWISNRGGIGVAPTKSWESWWEKEQEPLRYSGKRGTILEILLALRFFVYQYGLVYHLNITKHTRSVLVYCFSWVVIFVILLVMKTVSVGRRRFSAEFQLVFRLIKGLIFITFVAIVVILIAIPHMTVLDIFVCILAFMPTGWGLLLIAQAIKPAVQAIGLWGSIKALARGYEILMGLLLFTPIAFLAWFPFVSEFQTRMLFNQAFSRGLQISRILGGHKKDRATRNKE

SEQ ID NO: 7096 - protein, 44 aa, Oryza sativa
  UNSURE (1)..(44): unsure at all Xaa locations
  Clone ID: PAT_MRT4530_99003C.1.pep
  unsure (1)..(44): unsure at all Xaa locations
QNLVASGVDGLRAGMGSGLIGTTQEVXAVGRGQATAVHKVASYA

SEQ ID NO: 7097 - protein, 96 aa, Oryza sativa
  Clone ID: PAT_MRT4530_99181C.1.pep
MAFNLEGPENERSLSLSFLCAMEEGRLMDIIGHHIQTDENAGVLEEVANLASRCLEMIGNNRPSMRDVADKFGRLRKVMQHPWAQHDPEEMVQHSK

SEQ ID NO: 7098 - protein, 97 aa, Oryza sativa
  Clone ID: PAT_MRT4530_99963C.1.pep
QGVRQKLCIRRSKNKKFVALKGLPTVRCPFRPVYCEIVINGRSYKVFKVADWLQALTAFALLDLLNTDFQHGGPVYSFWRNHGQSCFLCEIVIRSQF

SEQ ID NO: 7099 - DNA, 315 bp, Zea mays
  misc_feature (160)..(160): n is a, c, g, or t
  misc_feature (242)..(242): n is a, c, g, or t
  unsure (1)..(315): unsure at all n locations
gcagttagtaagtttttaatattgtgtatagctcctgaaatctgaaaactcttgacgtctgtaatcatgtgaaaaattcgtacaggtaaaatatgttagtggctcctatgatagggtggaaggatttgagttattaaataaggcaatctctgagtatganacttcaaaaaacaatgactcgggaagctaccgcagattattttatttggcattgcctccatcagtctacccatcagtatgcnaaatgataagatcatattgcatgagtccatcttcacacaccggttggacaagggttattgttgaaaagccctt

SEQ ID NO: 7100 - DNA, 305 bp, Glycine max
  misc_feature (53)..(54): n is a, c, g, or t
  unsure (1)..(305): unsure at all n locations
tgaaagcaataagtccctcctttcctctgccttataattcttgtgaccctttnngctggtagcattgaaagtggcaccagcaaacgtgaagccaagccattatgctgcacccttcaataggagtgtttttccttctggttttctatttggaataggctctgcagcttaccagatagaaggagcagcagctatagatggcagaggaccaagtatatgggacacctatactaaacagcaaccagggaagatttgggatcatagtgatggaagtctagcaattgatttttatcaccggtacaagagcg

SEQ ID NO: 7101 - DNA, 484 bp, Zea mays
cgctgtgttaccagctttgaccgccgcctcccttcccctccgctactgctcctccccaccccactcccccgcaggagcggcggcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggcggtggaggatcccatgttgatccatttgacatcttctcatcattttttggacccttttttggaggaggtggtggaagcagc

SEQ ID NO: 7102 - DNA, 284 bp, Glycine max
  misc_feature (266)..(266): n is a, c, g, or t
  unsure (1)..(284): unsure at all n locations
ttcagtaggttccaggagaagcgttgataatagggagggaaagctatcagtaaaattgaaggcgggtagaatttcacgtgacttacatcctgcatcccacaaattatcttcaatagaggtccgggttgaggatgctaaagacacagccagggtccaagctaaaaaatcttctgaactaaagaatagtcatttgcttgaaggtggtgttcatgttgaacaacctggttattgtgctaatggtaaacgttatgaggagaaagtaaacnaggacaatcaggaaagtg

SEQ ID NO: 7103 - DNA, 454 bp, Zea mays
gtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcgggtacggtggtggccgtggaggcggcggctacggcggtggcgggcgccgtgatggcggcggcggctacggcggtggcggcggc

SEQ ID NO: 7104 - DNA, 176 bp, Zea mays
ggtaccccgtttttcggggagggaaacaaaactttacccgtaagggaaaaacgccgccccaaaaaaaaaacctccaacaaccggggaccaagtgttggggcatgaactgtctaaaaaggggacaaaaaaaaccagggggccccaacaaaacccttcaagggtaccaaaaacaaaac

SEQ ID NO: 7105 - DNA, 129 bp, Glycine max
cgacccacgcgtccgatttttacaaacacctgtgtaacataccaacaattatgaaatatacagtatataccataattggtgtatgttacacaggtgtttgtaaaaatagtttttatcattattttagta

SEQ ID NO: 7106 - DNA, 342 bp, Glycine max
ggtcgacccacgcgttcggtcagtctttagagctaaaaatggtctcactctttcatcttagtatgtgttgacatgctggacggggaatgctaaaaccggtacattgttagatgaacatgcatctgaattgccaagtacttctcgtgaatctgtaccagtttgttataacaatttacgacaagaagcaatcaaatatgttgaaaaaagtgcaaaatcaatccaaatctatcatgttgccatgagagctttgaaagaagctgcttagaaagtttgcaccattaaaaattagagttctggaacagccgagggagctacagcaaccaatggaagcaggggtgaatt

SEQ ID NO: 7107 - DNA, 399 bp, Glycine max
  misc_feature (26)..(26): n is a, c, g, or t
  misc_feature (122)..(122): n is a, c, g, or t
  misc_feature (135)..(135): n is a, c, g, or t
  unsure (1)..(399): unsure at all n locations
ggaatttccggggggacggacgcgtncgaagaataataagaagaagcaagagatagagaggagagaatatggcgaccacacgcggttggtttggcactatgttgagcacctccttccttaanaggcaggcatcantgaacatgacaagcttcaaggctaacgctgctgtctttggtgtaaaaagaggacgaggaggtcgtgtgagggccatggcaacttacaaggtgaagctgataactccagagggagagcaagaatttgaatgcccacatgatatatacattcttgatcaggcagaggaaaatggcattgatcttccctactcatgcagggctggttcttgctctgcatgtgctgccaaagttgtgagtggcaaactggaccagtcagatggtagct

SEQ ID NO: 7108 - DNA, 380 bp, Glycine max
cgacgagttcggccacatgctcgccgtaatcctcaaggaaaacggcgttcgcgccgacggcggcaactttgaccagggcgcacgcaccgacctggccttcgcgaccctacgcgccgacggagagcgtgagttcatgtactacagaaaccccagcgccgacatgctcctcaagcccgaggaactcaatctcgaactcatcagatctgcataagttttccattacggatcaatcagttagatcgtgtagccatgcagatcagcacacttgtaggcaatggaagtagccaatgaatctgggtgcttgctctcctatgaccctaaccttcgactacctttgtggtcgtcggctgatgaagctcgtaagcaaatactgagcattt

SEQ ID NO: 7109 - DNA, 257 bp, Glycine max
tgctgcttctggaaattttcattggaattttgaagatgttgctaaatcaattgtgtgcatgatgatgtctggcccattcttgacaggatatacccagactatgaatgattggtacgaccgagaaattgatgcaataaatgaaccttatagaccaattccttctggggcaatatctgagaatgaggtaatcactcaaatatgggtgttgctgcttggtggtctttctctggctggtatattggacatatgggcagggc

SEQ ID NO: 7110 - DNA, 261 bp, Zea mays
caagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctag

SEQ ID NO: 7111 - DNA, 267 bp, Zea mays
  misc_feature (30)..(30): n is a, c, g, or t
  misc_feature (97)..(97): n is a, c, g, or t
  misc_feature (146)..(146): n is a, c, g, or t
  misc_feature (165)..(165): n is a, c, g, or t
  unsure (1)..(267): unsure at all n locations
gaacggcgtcaccaactggatgggcacgancgccatcacgccgctcgtcgccgccttcctcgccgacgccttcctcggcagatactggaccatcgcnctcttcctggtcatctccgtcctggcctacgtggtgctcacggtgagcncggcggcggcgctggagancgcggccttctacgcggggctgtacctgctggcgctgggcggggcgctgcagccggtgctgtcgtcgttcggcgccgaccagttcgacgaggaggagcgcgg

SEQ ID NO: 7112 - DNA, 234 bp, Zea mays
ttttgatgtatgttttaggcagaagaaggcttttgcaggtgaaacttcttcatcttaagaagttcatgctgctgtacgcaattggctgaagaccaacatatcacacgatgttgcttctagcactcgaataatctatggaggctctgttcaaggataagaagccagtcaaggtcatcaagaagaactcggctgcagtcaccaagttcctcgatgagctggctaagattggccgca

SEQ ID NO: 7113 - DNA, 487 bp, Glycine max
  misc_feature (297)..(297): n is a, c, g, or t
  misc_feature (311)..(311): n is a, c, g, or t
  misc_feature (336)..(336): n is a, c, g, or t
  misc_feature (343)..(343): n is a, c, g, or t
  misc_feature (357)..(357): n is a, c, g, or t
  misc_feature (415)..(415): n is a, c, g, or t
  misc_feature (418)..(418): n is a, c, g, or t
  misc_feature (439)..(439): n is a, c, g, or t
  misc_feature (442)..(442): n is a, c, g, or t
  misc_feature (449)..(449): n is a, c, g, or t
  misc_feature (458)..(458): n is a, c, g, or t
  misc_feature (461)..(461): n is a, c, g, or t
  misc_feature (467)..(467): n is a, c, g, or t
  misc_feature (475)..(475): n is a, c, g, or t
  misc_feature (478)..(478): n is a, c, g, or t
  unsure (1)..(487): unsure at all n locations
ccacgcgtccgaaacaagcccttatcacaactctatctaacaaattacataggacaggcccaaaaccaaaagaagcttctttgtctctcgtgccgattctccaccactattcccttcaccccaatcacactttccggtagttgttgctattagtgtagaagatgagtacgctggatgcaacaagggctgaacttggtcttcttgttttatatttgggcaaggctgaagcaagggacaaaatatgcagggcaatacaatatggttcaaatttttgagtaatggggaacctggtactgntcaaaatgtagacnaaacaaccagcttggcacgaaaagncttccgnctctttaagtttgncaatgacctacatgctttgataagtcaacaccacaggggacaccccttcccctaactntgntgggaaaagcccagaatgctntanttttcantttcttggntcntggacnaattgggnggntttggcaaa

SEQ ID NO: 7114 - DNA, 235 bp, Glycine max
tcctaacttaccatgctgctgcaccacccgtgtgctcccggttccctctctgtgcctccgggggttctttgccccgcccgccgtcgggccggtctgtcgggcgttctcccggggtcggtccgtttgggatccggtatttccagggcgctgccgctttagcctttggtttctgggcgcctgggctccgctccccagtcggggtccccggctccgtctgcttccccgacccctgtct

SEQ ID NO: 7115 - DNA, 254 bp, Glycine max
  misc_feature (24)..(24): n is a, c, g, or t
  misc_feature (30)..(30): n is a, c, g, or t
  misc_feature (32)..(32): n is a, c, g, or t
  misc_feature (41)..(42): n is a, c, g, or t
  misc_feature (74)..(74): n is a, c, g, or t
  misc_feature (85)..(85): n is a, c, g, or t
  misc_feature (152)..(152): n is a, c, g, or t
  misc_feature (162)..(162): n is a, c, g, or t
  misc_feature (233)..(233): n is a, c, g, or t
  misc_feature (240)..(240): n is a, c, g, or t
  unsure (1)..(254): unsure at all n locations
ggaaatctgaagctaccttaaggnaaatgnanatggccaanncgcaacactagtcatcgcttcaagctacttgncttttccttcnaactctgcactcttcattcgctgagattttcttcgaagagagattcgaagatggatggaagagccgntgggtgctanccgattggaaaaggagtgaaggaaaagcgggtaccttcaagcacacagcaggaaaatggtctggggatccngatgacnaaggtcttcagaca

SEQ ID NO: 7116 - DNA, 298 bp, Glycine max
  misc_feature (7)..(7): n is a, c, g, or t
  unsure (1)..(298): unsure at all n locations
cagaganagagtttgaggctctggccaaagggtctggattccaaggtttccgagtcctgtgctgtgctttcaatacctacgtcatggagtttctcaaaaaggtttaagttctttggcgtggattcataagttgcatttgagttttgactttgagacctgcatgtggtgctacttacaaaagctttcccggaaaaatgtaaatttctcttaattcattaggaaaagaataataaacaagttcaatgtatactgccttttatataataacaagtttcatactgtggtttatacaaaaaaa

SEQ ID NO: 7117 - DNA, 100 bp, Zea mays
  misc_feature (2)..(2): n is a, c, g, or t
  misc_feature (8)..(9): n is a, c, g, or t
  misc_feature (11)..(11): n is a, c, g, or t
  misc_feature (17)..(17): n is a, c, g, or t
  misc_feature (36)..(36): n is a, c, g, or t
  misc_feature (40)..(40): n is a, c, g, or t
  misc_feature (54)..(54): n is a, c, g, or t
  misc_feature (58)..(58): n is a, c, g, or t
  misc_feature (80)..(80): n is a, c, g, or t
  misc_feature (92)..(92): n is a, c, g, or t
  misc_feature (94)..(94): n is a, c, g, or t
  misc_feature (96)..(96): n is a, c, g, or t
  misc_feature (99)..(99): n is a, c, g, or t
  unsure (1)..(100): unsure at all n locations
tntttttnnanccatancaccacatatccacatttnaatncacaacacatttancaanattaatttactacttccatcanatcttaacattntncnctnt

SEQ ID NO: 7118 - DNA, 1405 bp, Zea mays
agcccatcctgccctttgaggtgttatctgctcgccttgggcgtagaccagaggacataatcaagttggatgcaaatgagaatccatatggtccacccccggaggtcgctgcagcactaggtagtctcaagttcccctatgtgtaccctgatcctgaaagccgccaattgcgtgctgcccttgctgaagattctggacttgaatctgattacatacttgctggatgtggcgcagatgaactaattgatttaattatgagatgtgtgcttgaaccaggcgacaaaattgttgattgccctccaacattcacaatgtatgagttcgacgcttcagtcaatggtgcacttgttatcaaggttccaagactgcccgattttttccctagatgttgatctcattgtcgaagtggttgaacaggaaatgccaaaatgcatatttctgacatccccaaataatccagatggcagtgtaatcaatgatgaggatcttttaaagatacttgatctcccaatacttgtagtgctggatgaagcttatattgagttttcaagccttcagtcaagaatggcatgggttaagaagcatgataatttgattgttctccgaacatttagcaaacgggcaggtttagctggtcttcgtgtgggttatggtgcatttcctctgagcattatcgagtatttgtggcgggccaagcagccctataatgtttctgtggccgcagaagtttcagcatgtgcagctttacagaatccaacttatctggagaatgtgaaaaatttactggtaaaagaaagggagaggttgtttaatcttctcaagggaataccattcctgaagccatttcccagtcattctaacttcattctctgcgaggtcacgtcaggaaaggatgcaaagaaaataaaggaagaccttgcgaagatgggagtgatgatccgccactatgacaagaaggaactgaaaggctatattcgtatctcggttgggaaacccgagcacactgatgcactaatgaagggcctgaatgcacttcgattgtgagagcttttgcacacgatcaagcttttgcacactatcaagcttttgcacaccatcacatcaatgtaaacagtgtattcctttgcggatatatatccgtcaggctggatgcagtctataagaggagattgcatcactccaacgcatgtgaagcccaaacagacaagggtcatgtgggtttcactatccttttgtttagcaagttgaagtctgtttttgttattcagtggcataacagctattcacaagattatcttgttcagaacaagtgtagcagttgaattcctggtaggtggtttctgatgttgggttgagacttgagagaactgaacattgtgtaggtataaataaaggccaacatagc

SEQ ID NO: 7119 - DNA, 280 bp, Glycine max
tctatttctcagtctctgtgtttgcggctgaggattccgaacgagtgaccttcttcgtttctcgcaaagtttaagtaatcatgggtaaggaaaaggttcacatcaacattgtcgtcattggacatgtcgactctgggaagtcaactaccactggtcacttgatctacaagcttggaggtattgacaagcgtgtgattgagaggttcgagaaggaggctgccgagatgaacaagaggtcatcaagtatgcctgggtgctcgacaagctcaaagctgagcgt

SEQ ID NO: 7120 - DNA, 298 bp, Zea mays
cattgacatcatttattgtcgtggaaagagatggctcaatcatagcgtgtgctgccctcttcccttttcttgaggataaatctggggaagttgctgctattgctgtatctgaagaatgtcgaggccaaggtcaaggagacaaattacttgattacgttgagaagaaggctttgtcccttggacttgagaaactattcttgcttaccacaaggacagcggattggtttgttcgtcgcggctttaaggagtgctcgttcgattccctgcctttggtgaggagaaaacgtatcgacctctc

SEQ ID NO: 7121 - DNA, 393 bp, Zea mays
  misc_feature (34)..(34): n is a, c, g, or t
  unsure (1)..(393): unsure at all n locations
ggcatggcatctcggcgtcgtctgcctcatcggnaactgcttcctgatgggcgcttacctcgtcatccaggccccggtgctgatcaaataccccgcgagcttatccctgaccgcctactcctactccttcgcaaccttgttcatggtggtcaccggcgcgttcgccaccagtgggctccacgagtgggcgctgacagcgaccgagatcttagccatcttgtacgctggagtcgttgcgtcctgcctgaactacgcgatcatgacctgggcgaacaagatcctcgggccgtctctggtcgccctctacaacccactccaaccggcatgctctaccttgctctcgaccatgttttttggaacttctatttacgttggtagtgtgaccgggggact

SEQ ID NO: 7122 - DNA, 1130 bp, Zea mays
ctgcgaaatgctgaatacaggctttcttttgaaagaaatctagaactgcctgaagaaggtgtagaatgcctaaaaagtgatgtcactgaagataatcatcataacatcaatttgggaagacctgtcactatttttagattatccgaagaagacatgcctcaggaccctggaaaaaccgatgaagcatcatcttatgaaaatatgggagaagagcttggtgacttaacaccacaggcagaggagtatattattcagatgcaatctcatttgaatgccatgaaaaaggagttacatgatctcaggagaaagaattctgccttacagatgcagcagtttgttggggaggaaaaaaacgacttgctggactatttgaggtcattaacaccagagaaggttgctgaactatcagaatcgacgtctcccggtgtgcaagaaactattcattctgtggttcatggtttgcttgctactctttcccccaaggtacattcaaaggcccctccaccgctagataacatttctggtggtgttctaaaccttgggggcgaggatgatgatcgtgcagaacttgtggagaatgcttccctcccatttcagcccctaatatctgttccccgtgattatcttgcacgtttgctgttctggtgcatgctgctgggtcactacattcggggtctggagtaccggttagagcttgctcggcttctgcgaatatccagcgtgggttctttctctggtggagatgatcatgttgtttgagggtaccacgtctactgatattcctcaccgggaagaatggaaaggaaagccctggtcaagaaatgggccatatggcagagctgcagaggtgtccgttacactgctgagctatatagttgtagttcctgtatattcagaaaacagtcactcggttgtaaagctagtgttacatatgcacgtgaaccattttctttttcttcctttgatgttgtgccgtataaaaagaatttggtggttcgttggtgtttatctcgtggtagcataataggcatccttgtattctagttgtatgtttctggtggttgtgactgctgtccagtgtccatttagcttttttgtctattcttgattcgagtaaagcttaacttctc

SEQ ID NO: 7123 - DNA, 235 bp, Zea mays
  misc_feature (134)..(134): n is a, c, g, or t
  unsure (1)..(235): unsure at all n locations
gtctgagtggtagtggcccggcctatatcttcctagcaatagaggccatggctgatggtggagttgctgctgggcttcctcgggaccttgcccttggtcttgcatctcaaacagttcttggtgctgcaactatngtgagccagacaggcaaacatccagggcaactgaaagatcaggttacttctccagcaggtactaccattgccgggattcaggagctcgagaagggcgcatt

SEQ ID NO: 7124 - DNA, 486 bp, Glycine max
cgttgttgaaatcaggtggcacggtgagctctcaaagaaactaaacagcttcaacctactacccattcagctgcatttcatagttttcctacacaaaccactatgatgcccacttatattaccggaatatattggtttctcaccattttttcctactcctctttatgtacaaacaagaaaaagcaagaagccgaagtggataaaatgtacagcaaaatctttccccacttcaatatagctttgcaagaacgtatcaattatggctagcgccaatatgattttcacacattcataggcaaagattgggcatgttccttatcagtattatgactactactgccatgggcaacaccattgctaagtttatcttccctcattgcatctcctaccagctgtgactgactgcctgatgaatctccagtaccagagttcacagtctgctgtttgagatatcgctcagtagcatcatggagcaacttcatcatg

SEQ ID NO: 7125 - DNA, 298 bp, Zea mays
gcaacaagcagtacccatacccgcgccgctgccgcaccggccgccccaggaccaagaaggaccccgagacggagatgcgcgagggccacaactacgtgccccgcgacgagcagttctcggaggtgaagcagctcacgttcggggccaccacgctgcgctccggcctgcacgcgctgctgccggcgctccgcccgctgctcatcaacaagaaggatctgcgcttcccgcacttccccgccatcgacgaactctacagcgacggcatcccgctgccgccgcagaccggttcgacgccatc

SEQ ID NO: 7126 - DNA, 287 bp, Zea mays
  misc_feature (201)..(201): n is a, c, g, or t
  misc_feature (232)..(232): n is a, c, g, or t
  misc_feature (272)..(272): n is a, c, g, or t
  misc_feature (280)..(280): n is a, c, g, or t
  misc_feature (285)..(285): n is a, c, g, or t
  unsure (1)..(287): unsure at all n locations
gagattattgaagctgatctcgtcctcctagctatgggattcttgggtcctgaagcgtctatcgctgagaaactgggtttggagaaggacaacagatcaaacttcaaagcgcagtttggagacttcgctaccagtgttgatggtgtgttcgcagccggggactgcaggcgtggacaatcactggtggtatgggccatcacngaggggcggcaggctgctgcagcggtagacnagtacatatccaggcatgatcagatgtcgcaggcgaaatnatcctttnggggngg

SEQ ID NO: 7127 - DNA, 248 bp, Glycine max
  misc_feature (2)..(2): n is a, c, g, or t
  misc_feature (8)..(9): n is a, c, g, or t
  misc_feature (41)..(42): n is a, c, g, or t
  misc_feature (87)..(87): n is a, c, g, or t
  misc_feature (124)..(124): n is a, c, g, or t
  misc_feature (248)..(248): n is a, c, g, or t
  unsure (1)..(248): unsure at all n locations
angtcgcnngcacgcgtacgtaagctcggaattcggctcgnnctcgagccgaatcggctcgagcggctcgagctgacatggcttctngcactcagaatttcaagactcatctctcgctcctttncttctacctccttcttttcacgaggtgggaatggtttccttggttcaagacactgcaaatacagcacttcttctgccattgaagaagaacccgttaaaccatcagtgcaagtagaacacacccn

SEQ ID NO: 7128 - DNA, 311 bp, Glycine max
  misc_feature (7)..(7): n is a, c, g, or t
  misc_feature (41)..(41): n is a, c, g, or t
  misc_feature (103)..(103): n is a, c, g, or t
  unsure (1)..(311): unsure at all n locations
gtcgcangcacgcgtacgtaagctcggaattcggctcgagnttcccttgtgttgtgcctccaaaagtcacgtgcgacgacacgtcgtcacgtgtcgacaccgngttgggcctttgtgtgtcgtttatgtataagaatgcgtgtgggtttgggtgttaaggtatcgttgggtgtgatcggtgtgagtctaatatttgcagtgctgaaaatgtcgcagttgttggacaaagccaaaaactatgttgcggagaaagtcacgaacatgcccaagcccgaggcgagtgtcaccgacgtggatttcaagcgcgtgac

SEQ ID NO: 7129 - DNA, 310 bp, Glycine max
  misc_feature (6)..(6): n is a, c, g, or t
  unsure (1)..(310): unsure at all n locations
gtcgcngcacgcgtacgtaagctcggaattcggctcgagcaacgaaccactctgaagccgctcacgttatccacaacactctcaaccctccttaaaccctaaccaatccaaccatggcttcttcttccaccttcactgcaatgtccgcctgcaagctctcctcctccgccgccatctcctccttcccctcccgccgccgctccaacgccgtcgttctgtcgaggcgcagcgcgccgccagggtctccgccatggccaaggagttgcacttcaacaaagacggcaccgcaattaagaagctccagagcggt

SEQ ID NO: 7130 - DNA, 854 bp, Glycine max
  misc_feature (792)..(854): n is a, c, g, or t
  unsure (1)..(854): unsure at all n locations
gtcgacccacgcgtccgggatggtgctcgggctcgggacgggctccacggccgccttcgccgtcgccgagatcggcgcgctcctggccgcgggcaagctcgagaagatcgtcggcgtgcccacatccaagcgcaccttcgagcaggcgcagtcgctcggcatcccgctctccacgctcgacgacaacccgctcatcgacctcgccatcgacggtgccgacgaggtttgaccctgacctcaaccttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaaggatgcgttggcagcaggacaggaaattgcagctctggaaggagttgttgaccatgggttgttcttgaacatggcgagttcagtgatcattgctggaacggacggtgtcagtgtcaaaacgaagtgagtttttgagttgctttgttgtttgtgttgagttttacaatttaatgtacaagctattggtgtaaaagcagctgataagatgcttcaataaaggtgttcccccaatgtggggattgactatcacttattgtggnnnnnnnnnnnnnnnnnnnnnnnnnnnnnnnnnnnnnnnnnnnnnnnnnnnnnnnnnnnnnnn

SEQ ID NO: 7131 - DNA, 307 bp, Glycine max
  misc_feature (9)..(9): n is a, c, g, or t
  misc_feature (53)..(53): n is a, c, g, or t
  misc_feature (104)..(104): n is a, c, g, or t
  misc_feature (111)..(111): n is a, c, g, or t
  misc_feature (129)..(129): n is a, c, g, or t
  misc_feature (131)..(133): n is a, c, g, or t
  misc_feature (143)..(143): n is a, c, g, or t
  misc_feature (146)..(146): n is a, c, g, or t
  misc_feature (148)..(149): n is a, c, g, or t
  misc_feature (158)..(158): n is a, c, g, or t
  misc_feature (160)..(161): n is a, c, g, or t
  misc_feature (164)..(164): n is a, c, g, or t
  misc_feature (167)..(167): n is a, c, g, or t
  misc_feature (172)..(172): n is a, c, g, or t
  misc_feature (176)..(176): n is a, c, g, or t
  misc_feature (179)..(179): n is a, c, g, or t
  misc_feature (184)..(184): n is a, c, g, or t
  misc_feature (204)..(204): n is a, c, g, or t
  misc_feature (217)..(217): n is a, c, g, or t
  misc_feature (225)..(225): n is a, c, g, or t
  misc_feature (276)..(276): n is a, c, g, or t
  misc_feature (296)..(296): n is a, c, g, or t
  misc_feature (307)..(307): n is a, c, g, or t
  unsure (1)..(307): unsure at all n locations
gagtcgcangcacgcgtacgtaagctcggaattcggctcgagctctgtctttngcactttcattctctcttaaaaatctaaatcccttttggtcttcatctttnccctctnatcccaggtatggcttcnannngcatcctganggngnncaaggattngnnganggntcctnctangtnatgcngcgcaggtgctgtggctgangacatgtttcacnggcaagcnacaatcatgggacctgctgatagcccatatgcaggtggtgttttcttagtntcaattcatttcctcctgantatcccttcan

SEQ ID NO: 7132 - DNA, 292 bp, Glycine max
  misc_feature (4)..(4): n is a, c, g, or t
  misc_feature (25)..(25): n is a, c, g, or t
  misc_feature (33)..(33): n is a, c, g, or t
  misc_feature (42)..(42): n is a, c, g, or t
  misc_feature (80)..(80): n is a, c, g, or t
  misc_feature (196)..(196): n is a, c, g, or t
  misc_feature (246)..(246): n is a, c, g, or t
  misc_feature (255)..(255): n is a, c, g, or t
  misc_feature (262)..(262): n is a, c, g, or t
  unsure (1)..(292): unsure at all n locations
agtngcatgcacgcgtacgtaagcncggaattnggctcgagntccaaaaacgcgtggactcaaaaactcttttctccatngcagttcataatcccccctgcatatccgcgtctgcaacaccactttcacaacgacgccgtttaaactgccacatctcaaactcaataatcctcgctccttcctttttccttctctngcgccagatggccgttgctgaccccaagcctcactccgaacctaaggtcnggaatttcntcaagcntccgttccgccattccgccaccaccatacg

SEQ ID NO: 7133 - DNA, 429 bp, Zea mays
gtaaccacagccagccaccaccgcgagaacaagtcgcagccaagagaagtcgtcctcgcgcgcgtctcgatctcccagcgaacgtagagcttgccgtgtgccgtgacttccatggagctactccacgccgtcatccatggagctgcgacgacgacgacgaccaccaccaccaccaccacgagcagcagcgccaccgtcaccagcggcgacgagggcgcccacctgccccaggggtgggccaagaagaagcgctcgcggcgccagcgtctcagaggaggagaacctcgcgctgtgcctgctcatgctctcccgcggcgaccgccaccgcgtccaggcgccggcgccgccggtcccgtccgcggagttcaggtgctccgtctgcgggaaatccttcggctcctaccaggcgctgggggggcaaaagaccag

SEQ ID NO: 7134 - DNA, 357 bp, Glycine max
attttccttttggatttgataatattaagaggaaccaggatagataggtaggttctagcctttctgttatcattttcgaaacaaaccaaattgaaactgtttgagttttgtttagaaggctgttatgaatgaaactttgaagcttagaaaagcggttaggtagctaggtttcagtttcagatctggtagagagcttcatcatgaagccattaccggcggagcaaaccggtgaatcagcgccgacggagttgcagagatccattccgacgccttttctgaccaagacgtaccagctcgtcgatgatccctccgcggatgacctaatttcctggaacgaagatggcaccagcttcatcg

SEQ ID NO: 7135 - DNA, 406 bp, Zea mays
cgcagtcggctgccgcagactggtagtagccggcgcgccgtcaccgtatcctcagatcagcggcgagcagataccacaccactctactgacgcccgacgagcagtgtaacattttccttcagccatgggtaaggagaagactcacatcaacattgtggtcattggccatgtcgactctggcaagtcgaccaccactggccacctgatctacaagcttggaggtattgacaagcgagtgattgagaggttcgagaaagaggctgccgagatgaacaagcggtcattcaagtatgcgtgggtgcttgacaagctcaaggctgagcgtgagagaggtattacaattgatattgccctgtggaagttcgagaccaccaagtactactgcactgttattgatgccccggga

SEQ ID NO: 7136 - DNA, 183 bp, Zea mays
cctaaacccagcaccagcgcccccaatcctttatacttccactcgagtagggttctgccggccggttccttgtcgtcgcaatggagttctggggtgaagaagtgaagccaggagccacggtttcttgcaaagttggtgatggtttgtttatccacctttcacaggctgccctaggggaaccaa

SEQ ID NO: 7137 - DNA, 216 bp, Zea mays
cagaaacacaccaagcgaagcgcactagcaacaacctaacaacaatggctaccaagatattagccctccttgcgcttcttgcccttttagtgagcgcaacaaatgcgttcattattccacagtgctcacttgctcctagtgccattattccacagttcctcccaccagttacttcaatgggcttcgaacatccagccgtgcaagcctacaggctac

SEQ ID NO: 7138 - DNA, 309 bp, Glycine max
  misc_feature (7)..(8): n is a, c, g, or t
  misc_feature (106)..(106): n is a, c, g, or t
  unsure (1)..(309): unsure at all n locations
cgtcgcnngcacgcgtacgtaagctcggaattcggctcgagcaaagataagaggcaaaccggttaggatcagtgcaaagagaagaatgggacttggcttgtttttnctcttttatccacttggtaacttcggctattgtcgaatccgtaaggcgaaggagagcaatcaaggagggatatcttaacaatgccaatggtgtgttgcatatgtctgcaatgtggcttttcccacaactttgcttgggtggaatagctgaagcattcaatgcaataggccaaaatgagttctattacacagagtttcctagga

SEQ ID NO: 7139 - DNA, 414 bp, Zea mays
tcgctccttttgctcggaacgcacacaccggccggtccccgatctccgatcccctcgtcgatccaaagatgcagatcttcgtcaagaccctcactggaaagactatcaccctcgaggtggagtcttctgacaccattgacaacgtcaaggccaagatccaggacaaggagggcatccccccggaccagcagcggctcatctttgctggcaagcagctcgaggacgggcgcacacttgccgactacaacatccagaaggagagcaccctccaccttgttctccgcctcaggggaggcatgcagatcttcgtcaagaccctcactggaaaagactatcaccctcgaggtggagtcttctgacaccatcgacaacgtcaaggccaagatccaggacaaggagggcattccttcagac

SEQ ID NO: 7140 - DNA, 323 bp, Glycine max
  misc_feature (4)..(4): n is a, c, g, or t
  misc_feature (11)..(11): n is a, c, g, or t
  misc_feature (32)..(32): n is a, c, g, or t
  unsure (1)..(323): unsure at all n locations
acgnaagctcngaattcggctcgagcagaganagagtttgaggctctggccaaagggtctggattccaaggtttccgagtcctgtgctgtgctttcaatacctacgtcatggagtttctcaaaaaggtttaagttctttggcgtggattcataagttgcatttgagttttgactttgagacctgcatgtggtgctacttacaaaagctttcccggaaaaatgtaaatttctcttaattcattaggaaaagaataataaacaagttcaatgtatactgccttttatataataacaagtttcatactgtggtttatacaaaaaaa

SEQ ID NO: 7141 - DNA, 285 bp, Zea mays
  misc_feature (2)..(3): n is a, c, g, or t
  misc_feature (10)..(10): n is a, c, g, or t
  misc_feature (54)..(54): n is a, c, g, or t
  misc_feature (144)..(144): n is a, c, g, or t
  unsure (1)..(285): unsure at all n locations
gnncaagacntgtgccatacttgacatttgatgaggcagctgaacttgcctatnttggagcgcaggttttgcatccacaatcaatgcggccagctagagaaggcgatgtacctgtgagggttaagaattcttataaccgtcgancccctggtacccttatcactaaagcaagagatatgagtaagactgttttgactagcattgttttgaaatcaaatattacaatgcttgatatagtcagcacacgcatgcttggccagtacggttttctagctaaggtttttt

SEQ ID NO: 7142 - DNA, 402 bp, Zea mays
cacaggcagcagctagcatcccttactctcggtacctgacctgaccacgagagcaacatgggcggaggacacgacatgcacgggcagcactacgggcacaacggcggcgtgaagggcttcgtgtccaacctcgtccacggcggcggcggccatggccatggaagcggctacggccatggccatggaaacggctacggccatgggaatggcggctacggcggcggccacgggtaccctcctcccgccgccggcggcgcgtaccctcacccgcacggcgcctacccgcccgccacctaccccgcgcactcggcgcactacgggcacacggggtcgtaccacaccagccacaacagctacggcggcggcggcggtcaccacggtatctacggtgggggcaagcac

SEQ ID NO: 7143 - DNA, 269 bp, Zea mays
  misc_feature (229)..(229): n is a, c, g, or t
  misc_feature (238)..(238): n is a, c, g, or t
  unsure (1)..(269): unsure at all n locations
gcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccagacacancaaagattngcgggataagcagcgcaactcccagtctccc

SEQ ID NO: 7144 - DNA, 221 bp, Zea mays
cccacgcgtccgcccacgcgtccgtgggaacaaaggacagctaccccgatcaattgtgatgttgtgtgtttgtgggtatgttctctctggagtttgagctgtggttattttatcgtgttggttgatcgtgtttgaaatgcttaattcaggactgtgacatctcgagttgttttaactaaatcttataagaactaccctgatcgagcgctgggtaattggat

SEQ ID NO: 7145 - DNA, 285 bp, Zea mays
  misc_feature (21)..(21): n is a, c, g, or t
  misc_feature (27)..(27): n is a, c, g, or t
  misc_feature (50)..(50): n is a, c, g, or t
  misc_feature (100)..(100): n is a, c, g, or t
  misc_feature (193)..(193): n is a, c, g, or t
  unsure (1)..(285): unsure at all n locations
cgcatcccgtccccgtccgcnccggcngacgccgccttttcgtccccgcntcaggtccgcggctccactgagcgtgcgcgtcaccggcggcaggcgaggncaggcggtggtggcgatggcgtccgctgatgcgcgcttggcggggatcgcctcctccatccgcgtcatccccgacttccccaagccagggatnatgtttcaggacatcacgacgttgctgctcgatcccaagggcgttccgtgacaccatcgacctctttgtcgagcggtacaaggaccaagggg

SEQ ID NO: 7146 - DNA, 129 bp, Zea mays
  misc_feature (2)..(2): n is a, c, g, or t
  misc_feature (19)..(19): n is a, c, g, or t
  misc_feature (54)..(54): n is a, c, g, or t
  misc_feature (56)..(56): n is a, c, g, or t
  misc_feature (66)..(66): n is a, c, g, or t
  misc_feature (86)..(86): n is a, c, g, or t
  misc_feature (100)..(100): n is a, c, g, or t
  misc_feature (118)..(118): n is a, c, g, or t
  misc_feature (127)..(127): n is a, c, g, or t
  unsure (1)..(129): unsure at all n locations
tngacacggtgctcaagancatcgagacgttcccgccggtggtgttcgccgganangcgcgtcacntcgaggagcgcatggccgangccgccattggccncgccttcatcctccaggncggcgactncg

SEQ ID NO: 7147 - DNA, 256 bp, Zea mays
caattcctcaggtgttctttcagttccagtacttcctgaaggaccctgtgaagtatgatgtcaaatatcaggcaagcgcacaaccattcttcgtactgggcctactggtgacagcactggcaaccagccattaatgaaggcaaacttaaacagaacgagcaaccgttctgataccgaagaggcacgtctggtgaccattaataagctagctgcttgtgtgcagggtaggaagagaacgtctttttacttgtagaac

SEQ ID NO: 7148 - DNA, 236 bp, Zea mays
gctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacc

SEQ ID NO: 7149 - DNA, 292 bp, Zea mays
gattgggacaaatattgtgttggcatatgaaccagtttgggctattggtaccggcaaagttgcaactcctgctcaggctcaggaggttcatgatggtctgagaaagtggctccactccaatgttagccctgcagttgctgaattgacaaggataatttatggagggtctgtaaatggagctaactgcaaagaacttgcagctcaaccagatgttgatggattccttgttggtggagcctcattgaagcctgaattcgtggacatcatcaagtctgccactgtcaagtcttca

SEQ ID NO: 7150 - DNA, 299 bp, Glycine max
  misc_feature (1)..(1): n is a, c, g, or t
  misc_feature (9)..(9): n is a, c, g, or t
  misc_feature (263)..(263): n is a, c, g, or t
  misc_feature (298)..(298): n is a, c, g, or t
  unsure (1)..(299): unsure at all n locations
ncgtcgcangcacgcgtacgtaagctcggaattcggctcgagcaaaggatttcaactttaggctccatctaaaaaaaatggctggtttggctagcaatcttcctctaattgttatgataggtctgcaaattcattatgcagcacttgccatattcacaagagccgctctcttagatgggttgagtacaacggtgtttgtagtatacaggcaaggcatagccactttggctttggcgcctatatttttctctcctaagaggagncaatcagtggaagattctttgggattcaggggttnt

SEQ ID NO: 7151 - DNA, 309 bp, Glycine max
  misc_feature (7)..(7): n is a, c, g, or t
  misc_feature (20)..(20): n is a, c, g, or t
  misc_feature (28)..(28): n is a, c, g, or t
  misc_feature (39)..(39): n is a, c, g, or t
  misc_feature (41)..(41): n is a, c, g, or t
  misc_feature (139)..(139): n is a, c, g, or t
  misc_feature (142)..(142): n is a, c, g, or t
  misc_feature (149)..(149): n is a, c, g, or t
  misc_feature (172)..(172): n is a, c, g, or t
  misc_feature (202)..(202): n is a, c, g, or t
  misc_feature (218)..(218): n is a, c, g, or t
  misc_feature (229)..(229): n is a, c, g, or t
  misc_feature (231)..(232): n is a, c, g, or t
  misc_feature (239)..(240): n is a, c, g, or t
  misc_feature (254)..(254): n is a, c, g, or t
  misc_feature (282)..(282): n is a, c, g, or t
  misc_feature (284)..(284): n is a, c, g, or t
  misc_feature (287)..(287): n is a, c, g, or t
  unsure (1)..(309): unsure at all n locations
gtcgcangcacgcgtacgtnagctcggnattcggctcgngntagtatcaatctattcttcatccctgttgatcaagaatgcaattctttggggggtctgagattagtccttcaccttcctgctccgacagcttcagganacnatggccntatgatgtatgtgttcaataggnatggtgtgtgcctgctctatagggagtggnatcgtccctgcggacnttggatgcccngnnagaccannagttaatgtttggnctattttcctctctgaagtcattaatgncnagntggaccccactagtgctgttga

SEQ ID NO: 7152 - DNA, 382 bp, Glycine max
  misc_feature (297)..(297): n is a, c, g, or t
  misc_feature (355)..(355): n is a, c, g, or t
  misc_feature (368)..(368): n is a, c, g, or t
  misc_feature (377)..(377): n is a, c, g, or t
  misc_feature (381)..(381): n is a, c, g, or t
  unsure (1)..(382): unsure at all n locations
ttcgccagaaaccgtgagctcgaagtgatccactccaggtgggccatgctcggggccttgggctgcgtcttccccgaactgttgtcccgcaacggggtcaagtttggagaagctgtgtggttcaaggccgggtcccagatcttcagcgagggtgggctggactacttgggcaacccaagccttgtccacgcccagagcatcctcgccatctgggctacccaagttatcctaatgggtgctgttgagggttatcgtattgctggtgggcccctcggtgaggtcactgacccaatctancctggtggcaactttgacccaatgggccttgctgatgaaccaaaagctttttgctgancttaaaggtgaangaactcaanaacng

SEQ ID NO: 7153 - DNA, 463 bp, Zea mays
ccacgcgtccgcaacaatttgatcaggcaataacctgacgaccctggtttgttctgtgaatgcattttcgtcgtgcttcaacaacagggaccggactacatggtccgcaacgcaaggaggtccatgctggaggagctggaggggatgctggagatcgtggagcctcagccgccggggaagccgaggacgcttagccgcaggaggttcgatctcccagaaggcgtagccatcgaaaaggagacgcgggaggcgggcaagtgaagtgcatcggtgggtggtggcatgcttgggcagtttggtatatgcgcgatgcggactatagagtttgagtttgtgctgctaccgaaccgtggaccaccttaccccgttgagatgtttgatagctggactttttgtgctgttgtatttgtagaccagaacgttgttctttgtaataaattggcgtgtgctgctttttgctaat

SEQ ID NO: 7154 - DNA, 206 bp, Glycine max
atcgttttgtgctgcaaggactttcaacattccggcgatgaacgccggcgttcttcgccgccgggcatcgtgggccgccggaatagtcggagcctcggtggccggcgctgcacttttgcgctcttgttcgtctaagcgctctgcgccattcgcttgcatgagcctctctactgataacaatttaaagggagctgttcaaactgaaa

SEQ ID NO: 7155 - DNA, 2170 bp, Glycine max
attcggctcgagggcagagaatcgaggaggcgcaagagtaggacgcggggaatcctgaacgccaaagactgaggcgaatatttagctgaaaataaattcacaccacaacccaacacaaacactttctctttctttctctcttcaatcttgatcccattttttttcttctctcttccttcctttggaattgaattcagcatcagcatgaacagcaggtctcaggatcaacgctcaagacctgccaagccagccacaatccatggctgcgccctctccggcgacctcgttggactccagaggctacttcgagacaacccttctcttctcaacgagagaaaccctgttatggcacagacaccacttcatgtctctgctggtcacaataggactgagatagttaaatttcttcttgattggcaagggacagataaggttgagatggaggccaagaatatgtatggagaaactccattgcacatggcagctaagaatgggtgcaatgaagccgcacaattacttcttgcttgtggtgctactgttgaagccagagcaaataacggtatgacacctttacatcttgctgtttggtactcactacgagcagaagaattcttaactgtgaaaacattgcttgagtacaatgctgattgcagtgccaaggacgatgagggaatgactcctttaaatcatctatcccaaggcccgggaactgagaaacttagggaactattactctggcatcttgaagaacaaaggaagcagcgagccattgaggcatgcagtgaaaccaaagctaaaatggatgagcttgagaaggaactatcaaatattgtcggtcttaatgatctaaaagtacaacttcgcaagtgggcaaagggcatgcttttggatgagaaacgtagatctcttggtctgcatgttggcaggagaagaccacctcatatggcctttctaggcaaccctggaacaggtaaaactatggtagcacggattcttggaaaattactccatatggtgggaattctacccactgataaagtgacagaagtacagcggactgatttagttggtgaatttgttgggcacactggtccaaaaacaaggaggaagatcaaggaagcagaggggggaattctttttgttgatgaagcctatagattgataccaatgcaaaagtccgacgataaggactatgggttggaagccttagaggagattatgtctgtcatggacagtggcaagattgtagtaatatttgctggctactgtgagccaatgaagcgagtcattgcttctaacgaaggtttctgtagacgggtgaccaagttttttcaatttaatgatttcaactcagaagaactagcgcaaatccttcacatcaagatgaataatttagctgaagatagtttgctatatggatttatgttgcatcccgattgctgtataaaagccttagcagcattgatagagagggaaacaacagaaaagcaacgtaaagagacaaatggaggtttggtagataccatgttggttaatgctagagaaaatttagacctaaggctcagctttgactgtatggatacagaagaacttcttaccatcacattggtagatttagaagcaggccttcagcaattaacacagtaatcattctttgcaatctagtagatattttggagagattcatttcagcttacctcaattttcacacaagtttgacatctgcacaatgaggaacatatcatgaataagtttggtacaataggttgattcttttgggagttcttttccttgtattttgtaattgataatattatataggcttcattcatgtactttgctatatttttttttatctgaataatgatttgtagacacctaatgcaaatctataccttgagagaaagaactagaagagagagaagtgattatttgatgagtgatatgatgtgattaagaagggagaggaagatagggagaaatgaagggtcaaatgaaatgagtgtttaggtagctatgtatcattgttgtttttatctgcctttcatttgtattcattgtatgttattattcattattgtgggggagtaacgaaatcttcttttatttgtggctgtcccaaaatattttcattattattaaccattaatgttaattggtgatgcttttt

SEQ ID NO: 7156 - DNA, 469 bp, Glycine max
  misc_feature (14)..(14): n is a, c, g, or t
  misc_feature (22)..(22): n is a, c, g, or t
  misc_feature (467)..(468): n is a, c, g, or t
  unsure (1)..(469): unsure at all n locations
ttaacttgcagcgnccaggtancggtcaggaattcccgggtcgacccacgcgtccgtacggctgcgaaagacgacagaagggggggggaaagagagtggattcttggtgactttcttgaccagaaaagtagcaaccgcagcaccaaagactttgctttgcatctatcgaattctaatccaattctctctgcatctacatatacaatatcataatcgttcataagattgcatttgcattgatttcaaaaatgcagatcaggggatcgagtcacagactctccagtatgggcaataatcgatcccgcattcccgcgctcctcatctccatgttcgccactttcgcttctatctacgtcgctggaaggctgtggcaggacgcagagaatcgcgtttatctcatcaaagagctcgataggatcactggccagggacaatctgctatatctgtggatgatacattgaagatnnt

SEQ ID NO: 7157 - DNA, 291 bp, Glycine max
  misc_feature (124)..(124): n is a, c, g, or t
  misc_feature (275)..(275): n is a, c, g, or t
  unsure (1)..(291): unsure at all n locations
ccgagggaaaaacttggcaacctacacacccagtgtggacatgggtgcgtttgtaattgtggtaaatgcagaaaaggttgctgtatctgggaaaaagaggacccaaaagctttacaggaggcantctggacgacctggtggtatgaccgtggagacatttgcccagctgcaaaacagaattcctgaaagaattattgaacacgctgttcgtggcatgcttccaaaaggaaggcttgggaggagactattcacccaccttaaggtttataaaggcncagatcatccacatgc

SEQ ID NO: 7158 - DNA, 369 bp, Glycine max
gatgagcttattgcgaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcacagttgagcttgctggcactaatggagaaaccaccactcagggtctagatggccttggtcagcgttgcgccaag

SEQ ID NO: 7159 - DNA, 92 bp, Zea mays
ttcacgggccgacccacacgtcaaccaactcttgctcacgcttccatgccactccaatgcggcatccaaaactctgtcggttacgttcgcaa

SEQ ID NO: 7160 - DNA, 305 bp, Glycine max
  misc_feature (85)..(85): n is a, c, g, or t
  misc_feature (90)..(92): n is a, c, g, or t
  unsure (1)..(305): unsure at all n locations
aaattcttccaccaagttatgggtttccttgtgttgcttcttttctccctcttaggtctctcttctagttccagcatatcaactncatcnnncccatattggaccttgacctaaccaagtttaccacacagaaacaggtgtcttcactgttccaactatggagagtgagcatggacgtgtctaccataaccacgaagaagaggcaaagagacttgagattttcaagaataacttgaactatatcagggacatgaatgcaaacagaaaatcaccccattctcatcgtttaggatgaacaagtttgc

SEQ ID NO: 7161 - DNA, 231 bp, Zea mays
cctcgatggaatcgtcagcaagtttagcgggggagtgccctttacctaccctgtggatctgttcgagcacttatgggtagtggacaggatagagcggctgggcatagggaggcacttcacaagtgaaatcaaggagtgcctagaatacgtacacaggtacttgggtgaccaaaggcttgccggcacgaaggaccgtccggtctcaaaatgtcgatgacacggccaatgggg

SEQ ID NO: 7162 - DNA, 67 bp, Zea mays
  misc_feature (45)..(45): n is a, c, g, or t
  misc_feature (49)..(51): n is a, c, g, or t
  misc_feature (54)..(54): n is a, c, g, or t
  misc_feature (60)..(60): n is a, c, g, or t
  unsure (1)..(67): unsure at all n locations
cgacaccgtgttaagttaatatataactggtgctttttatttaanaaannnaanaaaaanaaaaaaa

SEQ ID NO: 7163 - DNA, 340 bp, Zea mays
gcggggtggatgtactacgccactggcaacagcagctacatcaccttcgccaccgacccgcggctgcccaagaacgccaaggccttcttcagcatcctcgacttctccgtgttcagctgggacaacaagctcccgggcgcccagctgctgctgtcgcgcctgcgcatgttcctcaaccccggctacccgtacgaggagtcgctagccggctaccacaacgccacagcctcaacatgtgcatgtacttcccgcgcttcgccgccttcaattcaccaagggcgggatggcgctcttcaaccacggcaggggcagccgctgcagtacgtcgtcgccaactctt

SEQ ID NO: 7164 - DNA, 238 bp, Zea mays
tggacacggtgctcaaaaccatcgagacgttcccgccggtggtgttcgccggagaggcgcgccacctcgaggagcgcatggccgaggccgccatgggccgcgccttcatcctccagggcggcgactgcgccgagagcttcaaggagttccacgccaacaacatccgtgacaccttccgtatcctgctgcagatgggcgccgtgctcatgttcggtggtcaggtgccggtcgtcaaggt

SEQ ID NO: 7165 - DNA, 245 bp, Zea mays
  misc_feature (58)..(58): n is a, c, g, or t
  unsure (1)..(245): unsure at all n locations
gcttgaagttgaatacacgattgggccaatccctgttgacgatgacgtaggaaaggangttatcacacagttgacagcaaatatgagtacaaacagtacattttatacagattccaatggaagggatttcctcaaaagggtgagaaactacagggaggattggaaccttcaagtgactcaaccagttgcaggaaattactacccggttaatctcggagtgtacatagtagatgagaaatatgaac

SEQ ID NO: 7166 - DNA, 238 bp, Zea mays
cgcttctctatttggagatgttgttccaactaagctggagcagccatttatattgaggacgccagatatgtcagccatgcatcatgactcttcgcatgacctcaaaactcttggatctaaactgaaggatatagttggggtcgcagatacttccctggaagtaagatacattacccgtcacatctgtcacttgtcgcagagcgtggagcacgcttggctgccgcagtatatatagcat

SEQ ID NO: 7167 - DNA, 312 bp, Zea mays
ccctgtgccaggccgtggacctgcgccacatcgaggagaacgtcaagagcgctgtcaagagctgcgtgatgacggtggcgaagaagaccctgagcaccaactccaccggtggtctccacgtcgcccgcttctgcgagaaggacctgctccaggagatcgagcgcgaggcggtgttcgcgtatgccgacgacccctgcagcgctaactacccgctgatgaagaagcttcgcaacgtgctcgtggagcgcgccctcgccaacggcgctgccgagttcaacgcggagacatccgtgttcgccaagtcgcccattt

SEQ ID NO: 7168 - DNA, 261 bp, Zea mays; identical to SEQ ID NO: 7110

SEQ ID NO: 7169 - DNA, 291 bp, Zea mays
ttccactcatgcagtggtgtatgctcggctgataactgaaggaaaggactatggtatacatggtttcattgtgcaactgcgaacttagaggatcactcccctcttcctggtattactctgggtgatattggtggaaaatttggcagtggtgcatataacagtatggacaatggtgttctgcgatttgaccatgtgcgcataccaagggatcaaatgttgatgaggctttcacaagttacaagggaggggaaatatgttcattcagatgtcccaaagcagctgctttatggg

SEQ ID NO: 7170 - DNA, 291 bp, Zea mays; identical to SEQ ID NO: 7169

SEQ ID NO: 7171 - DNA, 2491 bp, Glycine max
attcggctcgagagttggagcaggtctgggtctggccgcgtgagttatttcccagccaggcatctgagagctttggtcttgacctcgacagagatcgccatggacgcatcggcggaggtggaccacctcgccgccgagaggtcggccgcgcgcttcgacgtcgaggcgatgaaggttgcatgggctggctcgcgacacgccgtcgaagtcggcgaccgcatggcccgactcgtcgcgtccgaccctgtcttccgcaaggataacaggaccatgctctccaggaaggacttgtttaaggacactctaagaaaggcagcccatgcatggaagcgtattgtcgaactacgtctcacagaggaggaagcaggtatgctgaggctatatgtcgatcagcctggttatgttgatctgcattggggcatgtttgttcctgctataaaaggtcaaggtactgaggagcagcagaaaaagtggttaccaatggcttacaagttccaaataattgggtgctatgctcagactgaactcggtcatggctcaaacgttcagggccttgaaacaactgccacatttgatccaaagactgatgagtttgtcatccacagtccaactctgacctccagcaaatggtggcctggtggcttggggaaagcttccactcatgcagtggtgtatgctcggctgataactgaaggaaaggactatggtatacatggtttcattgtgcaactgcgaagcttagaggatcactcccctcttcctggtgttactctgggtgatattggtggaaaatttggcagtggtgcatataacagtatggacaatggtgttctgcgatttgaccatgtgcgcataccaagggatcaaatgttgatgaggctttcacaagttacaagggaggggaaatatgttcattcagatgtcccaaagcagctgctttatgggacaatggtttttgttcgccagacaatagtcgcagatgcttctaaggctttgtcccgtgctgtttgcattgctgtacgatacagcgccatccgaaagcagtttggctctcaagatggtggacctgagactaaggtccttgattacaagactcaacaaagcagactctttccgttgctggcttcagcatatgcatttagatttgtgggtgactggctgaagtggctatacatggatgtcactcagaaactggaagctaaagactactcaacactgcaagaagcccatgcctgtactgctggtttgaaggctgtgacaacatctgcaacagctgatgccattgaagaatgtagaaagctctgtggcggacatggttacctgaacagcagtgggcttcctgaattgtttgctgtctatgttcctgcttgcacttatgaaggagacaatattgttctgcttttgcaggttgcaaggattctaatgaagaccgtatctcaattgacatctggaaagcaacctgttggtacaatggcttacatgggcaatgtacaatatctgatgcaatgcaaatgtgctgttaacacagccgaagattggcttaaccctgttgccatacaagaggcgtttgaagcccgggctctcaggatggcagtaaactgtgcccagaacataggccaagcagcaaaccaagaagaaggtttctatgagcggtcccctgatttgctagaggctgcagtagctcacatccagttggtcattgtaaccaagttcattgcgaaggtacagcaggacattcctggacctggagtgaaggaacagctccagaacctttgcaatgtctatgccctctacattctccacaagcacctgggcgacttcctggcaaccgggtgcatcacacccaagcagggagcgctggcaaacgagcagctgggcaagctttacgcacaggtgcgtccaaatgctgttgcgctggtggatgccttcaactacacagaccactacctggggtctgtgctggggcggtacgatgggaatgtgtacccagcgctgtacgaggaggcgtggaaggaccctctgaacgagacggtggtgcccgaggggtaccacgagtacctccgccccttgctcaagcagcagctcaagctctccaggctctagtctgatcggctaccccccctggaattctccatggcggctgccttctcagagaatctcacgcgacctccgaatgaaagtgatgtaagctactaacgattcttgttagagccaggaaagaggctctccagccaattataaatttattcctcaagctctgaggatcaagttcaagctgtggattatataggaagcacgtttaataattaataaagagggagaggatgagcatctctctgttgctgctcaagtgttgtgcgcagtgcgagtagtagaatgaatatatacgagtgcgtgtattgtatggtgaattgaagttccatttgtttgctaaaagtatatcagaaaacaatggcttgatttgcctaagtccaaaaaaaaaaaaaaaagg

SEQ ID NO: 7172 - DNA, 332 bp, Zea mays
  misc_feature (82)..(82): n is a, c, g, or t
  unsure (1)..(332): unsure at all n locations
cttattctgggctggagatcatctgtaccgtatggattaccaaaagttcattcaagctcatagagaaacagatgctgatatnacagttgcagccctgccaatggatgaacaacgtgcaactgcatttggtcttatgaaaattgatgatgaagggaggatagttgagttcgcagaaaaaccaaaaggagagaagctgagatcaatgatggtagacaccactatattggggcctgatcctgaaagggccaaagaatgccttatattgctagtatgggaatctagtttttagcaagatgtgatgcttcggcttctcagagaaaatttcctgcagc

SEQ ID NO: 7173 - DNA, 316 bp, Glycine max
  misc_feature (7)..(7): n is a, c, g, or t
  misc_feature (306)..(306): n is a, c, g, or t
  unsure (1)..(316): unsure at all n locations
gtcgcangcacgcgtacgtaagctcggaattcggctcgagcggctgcgagaagacgacagaagggggtggcagttgtgtgacacagaaattaagctagagcttcatagtttcttcttcttttctcaccttccttctctcccttcagacaaagggacaaaaaatcagtgtgtgagagagagagagagaaattccaaaaccatgtcccacagtcatctaagtttcgcctttgggattctaggtaacattgcctccttcgtgtgctttctggcaccactaccaacattttatagagtttgtaagaaganatcaaccgag

SEQ ID NO: 7174 - DNA, 301 bp, Glycine max
  misc_feature (4)..(4): n is a, c, g, or t
  misc_feature (7)..(7): n is a, c, g, or t
  misc_feature (15)..(15): n is a, c, g, or t
  misc_feature (19)..(19): n is a, c, g, or t
  misc_feature (27)..(27): n is a, c, g, or t
  misc_feature (51)..(52): n is a, c, g, or t
  misc_feature (162)..(162): n is a, c, g, or t
  misc_feature (289)..(289): n is a, c, g, or t
  unsure (1)..(301): unsure at all n locations
cgtngcnctagcgtncgtnagctcggnattcggctcgagattggagtctannatggcaagaccttcaaccaggttgaaatcaaacccgagatgattggacattatctcgctgagttctctatttcatacaaacccgtcaagcacggtaggcctggtattggngccactcactcttccaggttcattcctctcaagtgaaaaaaacctctgcaaaatccccatctttttcagattttgtttttatttcagctgcctattgtatggttatcatgactgatccatagtatcnacatttatttaa

SEQ ID NO: 7175 - DNA, 305 bp, Glycine max; identical to SEQ ID NO: 7160
  misc_feature (85)..(85): n is a, c, g, or t
  misc_feature (90)..(92): n is a, c, g, or t
  unsure (1)..(305): unsure at all n locations

SEQ ID NO: 7176 - DNA, 306 bp, Glycine max
  misc_feature (5)..(6): n is a, c, g, or t
  misc_feature (49)..(50): n is a, c, g, or t
  unsure (1)..(306): unsure at all n locations
tcgcnngcacgcgtacgtaagctcggaattcggctcgagggagcggagnncgtagttcagaggctcccatcccatacccatgagatccttctcctcttccctctttctccttctcttcttcttctcttcttcactctccaatccccaaaatgcccctctctcactcaaaggtgttatattgaaaggccggttttggagttctccccttccgttcttcccggtatttcgggttctctaggtgttaaggacgctttacgatgcgagcgtgttcgggtttcgggcatctcgagagtgaaattgggagct

SEQ ID NO: 7177 - DNA, 501 bp, Oryza sativa
ccctcgcgttcgccggaggcgcctccgcctccacggccactataagagcgcggcggcggcggcggcgggggcggggggccatggcggggaagaaggaggaggaggaggctgttgtgtacaggggcgacaagctgatcctgcgggggctgcggttccatggcacccacggggtgaagccagaggagaagaagctgggccagaagttcgtcatcgacgtcgacgcctggatggatctcgccgccgccggggactccgacgacatctccgacaccgtcagctacaccgaaatctacaggatagccaagaatgtagtcgaaggcccgtcgcacaatctgttggaatcggtggctcagtcgattgcaaactcaaccctgctcaagttccctcagatttctgcagttcgagtgaaggttgagaaacctcatgttgctgttcagggagtcctcgactatttgggcgtggagatattcaggcagagaaaagcatgaacaacacctatac

SEQ ID NO: 7178 - DNA, 488 bp, Zea mays
cctaaaaatagtttcgtatatatccggatctggtattacaatagtaacacgtgttttgttgtggtacaaataatacgtcccgagtcggataaatcttccgatctccaataacagtgtacgtacatacctgcatggcacgaaattatgcagttcatcatggactggaacggagcggtgtgtaaaagcgcaggcgctactggtaataatagcgtactgctgggggggtatcttggctggctgcatccaattccaacaacaatgatgtggtgttggtggtggctacggaaggacggggggtgccacccggcaggtgttgtgggactggcagtggcagcacttgtggcccgccacgccggagaagacctgcgtcgtgtccctgcagtcgttgcacacgacccatccctttcccgtgtacaagtagcttgcctccatctctgcgtcgagggccttgaagaacttgtccatgtcgaagatgggcgtggcgcata

SEQ ID NO: 7179 - DNA, 501 bp, Oryza sativa; identical to SEQ ID NO: 7177

SEQ ID NO: 7180 - DNA, 252 bp, Zea mays
ggagttcaacgccaacaacatcagggacaccttccgcgtcctcctgcaaatgtccgttgtgctcatgttcggaggccagatgcctgtcgtcaaggtgggaagaatggcaggtcagtttgcgaaccaaggtcagatggttttgaggagcgggatggattgaagttgccaagctatagaggggacaatatcaatggggatgcattcaatggggagtcaaggttgccagatccacaccgcatgataagggcgtac

SEQ ID NO: 7181 - DNA, 416 bp, Zea mays
attaccataggctcattcatcgaaacgcaaatcagagagacaggaaaagaaaaaagaattttgatcaaatcaatagaaggaaggatcccttacctgatttgaatttcatcctcctttaaataggatatgctctaagtcttcccatactttcctataatgactgcaacgattttctccattttgcgaattcctattttatttgaagtatattactatcatatacattatctaaatcgatccactttaaataaaatagaaaaaatcgaaagaaaaaaaaaaagaaagagtaaataataaaacaggatattctgtttcataattctgaaatagagttcttttttttagtattactcctcattaggatgtatatattaatcatcctattttaatatatattaatcatcctattttaatta

SEQ ID NO: 7182 - DNA, 600 bp, Glycine max
  misc_feature (587)..(587): n is a, c, g, or t
  unsure (1)..(600): unsure at all n locations
taaagccattccacaaacgaactaaaacattctttcttgcactaaagagcagctgcagacaaacaagcctcttttggggttggattagctggtgagatccatggaagatataggtccgaattcatgcacaaggccagtgacagagaagaaagcaagaccccaagaacaattgaattgtccaaggtgcagttcaaccaacacaaagttctgttattacaacaactacagcctcacacagccaagatacttctgcaagacttgtagaaggtattggacagaaggagggtctctgagaaacgttcccgttggaggtggctctaggaaaaacaagagggtcacctcatcaaaggttcctgacttgaatccaccaattagcctctcatcagtctcagccatttcttcccaaaaccctaaaatgcaaggagtccatgaccttaatctggcttttcctgcagctatggacaagtatcatcatggcacgtctccgtatgttgagatgccaaaactcgaaaatggtggtgatcacagtactagtcatcatagtcaccaccatagccatagcccttctcttgagttgagctactacngtctggcatggat

SEQ ID NO: 7183 - DNA, 416 bp, Zea mays; identical to SEQ ID NO: 7181

SEQ ID NO: 7184 - DNA, 350 bp, Glycine max
agctccgctaccaccgaacacgttcgtacaatggcgggggtgacgaggagatggaacggggaaaacttaggtctaccctagcacccatgatcctgaagctcgtgctgagctgcgcaatccaaacggcggcgatctcattctatcgctagccgaacccagcatcgataccgaccctgggcggggctggacggggagagatcggaccagaggagctccaaccacgagcagagcgagacaagaatgtggcccgagtgagactacaaccattgactggttgtgatggagtttccatacggacctgcacacactcgtgaacaacggagtgacacttacgttgacacttgtgccac

SEQ ID NO: 7185 - DNA, 131 bp, Glycine max
  misc_feature (54)..(54): n is a, c, g, or t
  unsure (1)..(131): unsure at all n locations
ctgcgatctgtttcgtgttgtagctagctcctcgaaaatgctggcacgcctcgncgcgagtcgcttcaacgagatccgtcagatttccgtcagccttctagggtttctcaaccgctctgaactaccacctt

SEQ ID NO: 7186 - DNA, 391 bp, Zea mays
atgaacaagcctcctgaaatgatatctggcaatatgacagcagccatgtgtgtgtattctggactctttatgaggtttgcatggatggtacagccccgaaattatttgcttctagcatgccatgcttccaatgaaagcgtccagctctttcttctccaggtacccctgagacctagcccagcggcctgctgccgtcttcttccgccgccgtcttcgtccgtagagcagagcacatcagagagcggggaggaagaaaaagcgatcgatggcgtccaactacgtggacacgacgggcgaggagggacggttccacggccctcacagccacagcaccagcacgaccccgacgggcggcgcggcggcggcggcatcgccgcgcaactttcggcgc

SEQ ID NO: 7187 - DNA, 418 bp, Zea mays
acgcgtccggttcgactgtgggttcctatggcggaacaagggatgcggtgaggccaaggacggcacaactgacgatcttctacgccggttccgtcaatgtgttcaagaccttctcagctgagaaggctcaggagctcatgttcttagccagcagaggatctattccaagctcatctcccgtggcctgtaaggcatacgctcctcctaatgtccctccagccatggtcacagcgcctgaggttcttctgcctgcgaagcagatgctgtttcaaaaaccacagcatctctcgccgcctccatccagtgtccctggcatcttgcagtctgcagctctccccaggagcgcctcatctagctctaaccttgactccccagctccaaaatcttcggttccgttagctgttcctcctgtaagcca

SEQ ID NO: 7188 - DNA, 206 bp, Zea mays
  misc_feature (152)..(152): n is a, c, g, or t
  unsure (1)..(206): unsure at all n locations
cccacgcgtccgaccggccccactcgcgtggttcctcatggagagccccaccctctggctcccaccgctcgtcctcctccgctggccgccgccgccgctctccggcccactcgccgcactccccgccgcgctctacgcgttccactacgtcnagcgcacgctggtcaaccggctcggcctcgccggcctgcgcggcgccccggccc

SEQ ID NO: 7189 - DNA, 291 bp, Glycine max; identical to SEQ ID NO: 7157
  misc_feature (124)..(124): n is a, c, g, or t
  misc_feature (275)..(275): n is a, c, g, or t
  unsure (1)..(291): unsure at all n locations

SEQ ID NO: 7190 - DNA, 463 bp, Zea mays; identical to SEQ ID NO: 7153

SEQ ID NO: 7191 - DNA, 309 bp, Glycine max
  misc_feature (2)..(2): n is a, c, g, or t
  misc_feature (8)..(8): n is a, c, g, or t
  misc_feature (62)..(62): n is a, c, g, or t
  misc_feature (128)..(128): n is a, c, g, or t
  misc_feature (132)..(132): n is a, c, g, or t
  misc_feature (137)..(137): n is a, c, g, or t
  unsure (1)..(309): unsure at all n locations
anactcangcacgcgtacgtaagctcggaattcggctcgaggttcaccactgatcgcttacnagctcgaaaaggttaatgaaggagcacgtcattgcgcttctactactcttccactttcacagatancgcntattnccataatcgcgctccttcctctctagggtttcttcaacttcatggcttcccctactcatttcgacgatgacttcgatttcggaggcggatttggcggaaggcattccaggtaataagaggtcgtctcccgattacgacgacgaggattatgacaacgatccttttgcaccga

SEQ ID NO: 7192 - DNA, 317 bp, Glycine max
  misc_feature (1)..(1): n is a, c, g, or t
  misc_feature (5)..(5): n is a, c, g, or t
  misc_feature (8)..(9): n is a, c, g, or t
  misc_feature (57)..(57): n is a, c, g, or t
  misc_feature (59)..(59): n is a, c, g, or t
  misc_feature (73)..(73): n is a, c, g, or t
  misc_feature (80)..(82): n is a, c, g, or t
  misc_feature (89)..(89): n is a, c, g, or t
  misc_feature (99)..(99): n is a, c, g, or t
  misc_feature (118)..(118): n is a, c, g, or t
  misc_feature (129)..(129): n is a, c, g, or t
  misc_feature (153)..(153): n is a, c, g, or t
  misc_feature (159)..(159): n is a, c, g, or t
  misc_feature (191)..(191): n is a, c, g, or t
  misc_feature (196)..(196): n is a, c, g, or t
  misc_feature (202)..(202): n is a, c, g, or t
  misc_feature (205)..(205): n is a, c, g, or t
  misc_feature (208)..(208): n is a, c, g, or t
  misc_feature (216)..(216): n is a, c, g, or t
  misc_feature (221)..(221): n is a, c, g, or t
  misc_feature (226)..(226): n is a, c, g, or t
  misc_feature (238)..(239): n is a, c, g, or t
  misc_feature (248)..(248): n is a, c, g, or t
  misc_feature (255)..(255): n is a, c, g, or t
  misc_feature (270)..(272): n is a, c, g, or t
  misc_feature (277)..(277): n is a, c, g, or t
  misc_feature (280)..(281): n is a, c, g, or t
  misc_feature (289)..(290): n is a, c, g, or t
  misc_feature (310)..(310): n is a, c, g, or t
  unsure (1)..(317): unsure at all n locations
ncgtnaanncggaattcggctcgagggttatgcatttggtgaaagcctttgagaagntntcactatagctaanagttcgnnnggaatanagatcacgcnggaggagcatgatcatgancatgaagagcnaaagaatacgagccaggtgatganatgggnttgccagggttgcaatttcaacaacatcctangcctnagacanttnccngctactantgatnatgcntctgcctcgggnncttctggantttggcntacgtctgatttggnnntgacntcnnagaacccnngtattgggcaagggatttcngtttctt

SEQ ID NO: 7193 - DNA, 305 bp, Glycine max
  misc_feature (1)..(1): n is a, c, g, or t
  misc_feature (5)..(5): n is a, c, g, or t
  misc_feature (7)..(7): n is a, c, g, or t
  misc_feature (11)..(11): n is a, c, g, or t
  misc_feature (17)..(17): n is a, c, g, or t
  misc_feature (65)..(65): n is a, c, g, or t
  unsure (1)..(305): unsure at all n locations
ncgangnagcntacgtnagctcggaattcggctcgaggaacaaggtgggtactgctgcgccaggngagcaaatttgctgattggcagagggtcagaatgcaggagacgtccaaagagatacctgcaggctcccttcctaggtcattggatgttattcttcgtcatgagatcgtggaacaggccagggctggcgacacggtgattttcacaggtactgtacttgctatacctgacataatggcattggcatctccgggagagagatcagagtgccgccgtgatgcttctccaacgcaggggtctag

SEQ ID NO: 7194 - DNA, 292 bp, Zea mays
  misc_feature (11)..(11): n is a, c, g, or t
  unsure (1)..(292): unsure at all n locations
agtttgcgcanattccttgccaacatagatggtcaatctgataaaaccgtcaccttcaatgggaagatgtacaggcttcccgcctggtctgtcagcatccttcctgactgcaagaatgtggtacttaatacagctcagatcaattctcaaacgacaggttcagaaatgagatacttggagtcgagcaacgtcgcatcagatggctcatttgtcacgccagaactggcagtatctgactggagctacgccatagagcctgtaggtatcacaaaggacaatgcacttacaaagg

SEQ ID NO: 7195 - DNA, 221 bp, Zea mays
  misc_feature (30)..(30): n is a, c, g, or t
  unsure (1)..(221): unsure at all n locations
gtttgaaggttgccctgggtgctgccagangtctagctttcttgcatgatgaaggaccctttcaggccatgtacagcgagttctcaactttgaacatccaaatagataaaggtttcactgctaagctttcaggatatggttgtgttggcttcaataccgaggagatatctaatgcacctgtgtctgcagcaaacctttcggtggagaccttggagaagggt

SEQ ID NO: 7196 - DNA, 320 bp, Arabidopsis thaliana
cacacgcgtccgctcctccatatcttaacaatttcatagcaaaccctaaaattgagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatg

SEQ ID NO: 7197 - DNA, 312 bp, Zea mays; identical to SEQ ID NO: 7167

SEQ ID NO: 7198 - DNA, 67 bp, Zea mays; identical to SEQ ID NO: 7162
  misc_feature (45)..(45): n is a, c, g, or t
  misc_feature (49)..(51): n is a, c, g, or t
  misc_feature (54)..(54): n is a, c, g, or t
  misc_feature (60)..(60): n is a, c, g, or t
  unsure (1)..(67): unsure at all n locations

SEQ ID NO: 7199 - DNA, 334 bp, Zea mays
  misc_feature (64)..(64): n is a, c, g, or t
  misc_feature (68)..(68): n is a, c, g, or t
  misc_feature (127)..(128): n is a, c, g, or t
  misc_feature (150)..(150): n is a, c, g, or t
  misc_feature (152)..(152): n is a, c, g, or t
  misc_feature (330)..(330): n is a, c, g, or t
  unsure (1)..(334): unsure at all n locations
cgctcctcgccgcgcctatcatccttgatctggtgctcctggctgagctcagcaccaggatccngctnaaacctgagggaacggacaagttccactcttccacccggtggccaccatccttagctanntcaccaaggcaccactggttcngnccggcacaccggtggtgaatgctctggcaaagcagagggcgatgctggagaacatcatgagggcctgcgttggcctggccccagagaacaacatgatcctggagtacaagtgagccaagcggcgtggcctgcagctggatatggaggaggctgcacgaagggaactagagaggcgagntatt

SEQ ID NO: 7200 - DNA, 59 bp, Zea mays
ggcgcccacgcgtccgcccacgcgtccgcccacgcgtccggactagttctagatcgcga

SEQ ID NO: 7201 - DNA, 508 bp, Zea mays
  misc_feature (3)..(3): n is a, c, g, or t
  misc_feature (9)..(9): n is a, c, g, or t
  misc_feature (20)..(20): n is a, c, g, or t
  misc_feature (32)..(32): n is a, c, g, or t
  misc_feature (37)..(37): n is a, c, g, or t
  misc_feature (137)..(137): n is a, c, g, or t
  misc_feature (307)..(307): n is a, c, g, or t
  misc_feature (317)..(317): n is a, c, g, or t
  misc_feature (321)..(321): n is a, c, g, or t
  misc_feature (337)..(337): n is a, c, g, or t
  misc_feature (341)..(341): n is a, c, g, or t
  misc_feature (343)..(343): n is a, c, g, or t
  misc_feature (350)..(350): n is a, c, g, or t
  misc_feature (352)..(352): n is a, c, g, or t
  misc_feature (355)..(355): n is a, c, g, or t
  misc_feature (357)..(361): n is a, c, g, or t
  misc_feature (372)..(372): n is a, c, g, or t
  misc_feature (374)..(375): n is a, c, g, or t
  misc_feature (380)..(382): n is a, c, g, or t
  misc_feature (417)..(417): n is a, c, g, or t
  misc_feature (423)..(423): n is a, c, g, or t
  misc_feature (443)..(443): n is a, c, g, or t
  misc_feature (448)..(448): n is a, c, g, or t
  misc_feature (481)..(481): n is a, c, g, or t
  misc_feature (485)..(485): n is a, c, g, or t
  misc_feature (503)..(503): n is a, c, g, or t
  unsure (1)..(508): unsure at all n locations
ggncttgtnttcttaatggnaggaattttttnggacngctcgtaccggtccggaattcccgggtcgacccacgcgtccgagaagaccggtagcttggccaccagtggcagctcggacatctgcttcaggttctcggncttcttcgcctaggtcactcgttgatggtgaaggttacaatagtgctgatgaacagggtccctgttacgcctcgagttatgatgattcggaaagagagcgtatgtttgagcatgacctaaggcgaatgaaagggttggaaatcagaaagacagccgaagatgggaactgnctattcaaanctgntgctgatcaagtttantggnantccaaancntantnnnnnggttaggcaantnngggtnnnttatatggaaagggaacgggatcatttctctcagnttatanctgaaatttttacattttantgtangaggaaaaggagagacacggtttatggggacantgtngagatccaacattttcanagatg

SEQ ID NO: 7202 - DNA, 231 bp, Zea mays; identical to SEQ ID NO: 7161

SEQ ID NO: 7203 - DNA, 267 bp, Zea mays
ctccagcatgcgctacatgtgcagcaagcctctgagcagacagcactgagaaggctgaaggctttctcgtacatgcgacatgccatcgacaaacctctctcaggtatgctctattctagggaaacactcaagggcacaggcctggatgaagagcagatgaggcaggttcgtgtcgcggataattgccatcgccagctaaacaagatactcgccgacttagatcaagataacattactgacaagtcgagttgcttggatttggacatg

SEQ ID NO: 7204 - DNA, 590 bp, Zea mays
  misc_feature (19)..(20): n is a, c, g, or t
  misc_feature (33)..(33): n is a, c, g, or t
  misc_feature (37)..(37): n is a, c, g, or t
  misc_feature (67)..(67): n is a, c, g, or t
  misc_feature (70)..(70): n is a, c, g, or t
  misc_feature (111)..(111): n is a, c, g, or t
  misc_feature (145)..(145): n is a, c, g, or t
  misc_feature (157)..(157): n is a, c, g, or t
  misc_feature (263)..(263): n is a, c, g, or t
  misc_feature (285)..(285): n is a, c, g, or t
  misc_feature (294)..(294): n is a, c, g, or t
  misc_feature (299)..(299): n is a, c, g, or t
  misc_feature (304)..(304): n is a, c, g, or t
  misc_feature (338)..(338): n is a, c, g, or t
  misc_feature (340)..(340): n is a, c, g, or t
  misc_feature (343)..(343): n is a, c, g, or t
  misc_feature (352)..(352): n is a, c, g, or t
  misc_feature (358)..(358): n is a, c, g, or t
  misc_feature (360)..(360): n is a, c, g, or t
  misc_feature (370)..(370): n is a, c, g, or t
  misc_feature (372)..(372): n is a, c, g, or t
  misc_feature (383)..(383): n is a, c, g, or t
  misc_feature (387)..(387): n is a, c, g, or t
  misc_feature (389)..(389): n is a, c, g, or t
  misc_feature (397)..(398): n is a, c, g, or t
  misc_feature (400)..(400): n is a, c, g, or t
  misc_feature (417)..(418): n is a, c, g, or t
  misc_feature (421)..(421): n is a, c, g, or t
  misc_feature (437)..(437): n is a, c, g, or t
  misc_feature (443)..(444): n is a, c, g, or t
  misc_feature (451)..(451): n is a, c, g, or t
  misc_feature (456)..(457): n is a, c, g, or t
  misc_feature (468)..(469): n is a, c, g, or t
  misc_feature (471)..(471): n is a, c, g, or t
  misc_feature (475)..(476): n is a, c, g, or t
  misc_feature (478)..(478): n is a, c, g, or t
  misc_feature (484)..(484): n is a, c, g, or t
  misc_feature (487)..(487): n is a, c, g, or t
  misc_feature (494)..(495): n is a, c, g, or t
  misc_feature (497)..(497): n is a, c, g, or t
  misc_feature (499)..(499): n is a, c, g, or t
  misc_feature (501)..(501): n is a, c, g, or t
  misc_feature (503)..(504): n is a, c, g, or t
  misc_feature (507)..(509): n is a, c, g, or t
  misc_feature (511)..(511): n is a, c, g, or t
  misc_feature (513)..(513): n is a, c, g, or t
  misc_feature (515)..(519): n is a, c, g, or t
  misc_feature (521)..(521): n is a, c, g, or t
  misc_feature (529)..(529): n is a, c, g, or t
  misc_feature (539)..(540): n is a, c, g, or t
  misc_feature (542)..(542): n is a, c, g, or t
  misc_feature (544)..(544): n is a, c, g, or t
  misc_feature (547)..(547): n is a, c, g, or t
  misc_feature (549)..(549): n is a, c, g, or t
  misc_feature (551)..(551): n is a, c, g, or t
  misc_feature (556)..(556): n is a, c, g, or t
  misc_feature (563)..(563): n is a, c, g, or t
  misc_feature (566)..(566): n is a, c, g, or t
  misc_feature (570)..(570): n is a, c, g, or t
  misc_feature (573)..(573): n is a, c, g, or t
  misc_feature (576)..(576): n is a, c, g, or t
  misc_feature (578)..(579): n is a, c, g, or t
  misc_feature (584)..(584): n is a, c, g, or t
  misc_feature (588)..(588): n is a, c, g, or t
  unsure (1)..(590): unsure at all n locations
ggaaggggcgtaatgttcnncttagtgattgtntgcnataccaccggtccggattcccgggtcgagncangcgtccgcaggaagaaaaattgttccaagatatatccactntactatctgaactttctcaactacatgatggggngagctatcctcnggatgttgaagctggaacaaatgatatttcaagtaatgagattgattgggctagaaagcgtaatgaacttttgacaaagcttcaaggattatgcaaatctatccgnatcacgttgtcaaatcatgttnatagagaanaactngagtngcgccattgttcgataaacatttttctgtagacnancangatatagantatcangncatataattngnaactactgttncttnangttttgtnntnaattgatacccttgggnnacntcaataactttatttnaaaagnnacaatanccatnnattctaggatnncntttnnanctaatnatnccctcanncnancntnnttnnntnantnnnnntntatttaantggtaatganngngnccntntnaactntattagnccntatnatnatnanntcttnttantt

SEQ ID NO: 7205 - DNA, 210 bp, Zea mays
gagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgac

SEQ ID NO: 7206 - DNA, 289 bp, Zea mays
agccatatttgaaacagttaagaattcatatataagagtgcatatatatatataatcctgccaagacaaaggtaatggagtcgtcacgcatgttccagccggccatcatcctgcttctcctgctcattgtgaccaccgatgtggcgcaggcggcgagggaatgcgagaaggacagcgagcgattccttggggcatgcatggcgtcggacaactgcgccaacgtgtgccgcggtgagggcttctccggcggcaggtgcagcacttccgccgccgctgcatctgcactaag

SEQ ID NO: 7207 - DNA, 530 bp, Zea mays
  misc_feature (2)..(2): n is a, c, g, or t
  misc_feature (9)..(10): n is a, c, g, or t
  misc_feature (14)..(16): n is a, c, g, or t
  misc_feature (18)..(18): n is a, c, g, or t
  misc_feature (23)..(23): n is a, c, g, or t
  misc_feature (27)..(27): n is a, c, g, or t
  misc_feature (281)..(281): n is a, c, g, or t
  misc_feature (308)..(308): n is a, c, g, or t
  misc_feature (394)..(394): n is a, c, g, or t
  misc_feature (401)..(401): n is a, c, g, or t
  misc_feature (423)..(423): n is a, c, g, or t
  misc_feature (444)..(445): n is a, c, g, or t
  misc_feature (478)..(478): n is a, c, g, or t
  misc_feature (525)..(525): n is a, c, g, or t
  unsure (1)..(530): unsure at all n locations
gnaggctcnntttnnncnaagtntacntttcgcctgccgtaccggtccggaattcccgggtcgacccacgcgtccgtgtgtttgtaaaaaatatctctgcacatctgggagtagctgtcccgcacattgagttgaagcatgtgattgctgctacaattgctcttaagggacttggaagtctcctttttattttgaccagctccctcggtgcttatctcctgctgctgtacctcgctctgatcagtcctatcgttcacgacttctacaactacgacacgganaaggaagaattcgcgcggctgtttgcnaagttcacccaggacgtggcgctagttggagctctcctcgtcttcctgggcatgaagaactccacccgaagcggcagggcaagaanaaggctnacaaggcgaagacgaactaatnagaagttgcttcgtcgggctnngcgggtgtcaggagaccaatagttggcccaatncgaaacaagtcgatgcgcattgagctgtcggttggccttttacatgnattgg

SEQ ID NO: 7208 - DNA, 504 bp, Zea mays
  misc_feature (2)..(3): n is a, c, g, or t
  misc_feature (13)..(17): n is a, c, g, or t
  misc_feature (21)..(22): n is a, c, g, or t
  misc_feature (33)..(33): n is a, c, g, or t
  unsure (1)..(504): unsure at all n locations
gnnaggctgtttnnnnnagtnnactttttcgcntgccgtaccggtccggaattcccgggtcgacccacgcgtccgtttcaagatccaaccagtccattctaaaggagatcagtcctgggtgttttggagggactgatgctaaagctcaaagtccaatactttggccacctcatgcgaagagttgactcattggaaaagaccctgatgctgggagggtttgggggcaggaggagaaggggacgacagaggatgagatggctggatggcatcaccgactcaatgggcgtgggtttgggtgaactcggggagttggtgatggacaggcaggcctggcgtgctgcgattcatggggtcgcaaagagtcagccatgactgagcgactgaactgaaccgagcctcagtttgcaaagttagacagttggaaatgcaagtttagatccagggtttcttgactggaaatcttgatatctgggataatctcttgggtctggtcctttgacaaga

SEQ ID NO: 7209 - DNA, 525 bp, Zea mays
  misc_feature (6)..(6): n is a, c, g, or t
  misc_feature (8)..(8): n is a, c, g, or t
  misc_feature (16)..(16): n is a, c, g, or t
  misc_feature (18)..(18): n is a, c, g, or t
  misc_feature (20)..(21): n is a, c, g, or t
  misc_feature (32)..(32): n is a, c, g, or t
  misc_feature (36)..(36): n is a, c, g, or t
  misc_feature (39)..(39): n is a, c, g, or t
  misc_feature (62)..(62): n is a, c, g, or t
  misc_feature (70)..(70): n is a, c, g, or t
  misc_feature (94)..(94): n is a, c, g, or t
  misc_feature (120)..(120): n is a, c, g, or t
  misc_feature (124)..(125): n is a, c, g, or t
  misc_feature (144)..(144): n is a, c, g, or t
  misc_feature (154)..(154): n is a, c, g, or t
  misc_feature (172)..(172): n is a, c, g, or t
  misc_feature (304)..(304): n is a, c, g, or t
  misc_feature (359)..(359): n is a, c, g, or t
  misc_feature (377)..(377): n is a, c, g, or t
  misc_feature (416)..(416): n is a, c, g, or t
  misc_feature (427)..(427): n is a, c, g, or t
  misc_feature (432)..(432): n is a, c, g, or t
  misc_feature (439)..(439): n is a, c, g, or t
  misc_feature (457)..(457): n is a, c, g, or t
  misc_feature (469)..(469): n is a, c, g, or t
  misc_feature (484)..(484): n is a, c, g, or t
  misc_feature (495)..(495): n is a, c, g, or t
  misc_feature (499)..(499): n is a, c, g, or t
  misc_feature (517)..(517): n is a, c, g, or t
  misc_feature (523)..(523): n is a, c, g, or t
  unsure (1)..(525): unsure at all n locations
atgtcncnactgtganancnnacttctttgcnaccncgncggaattcccggattcgacccangcgtccgntcgtacgtgaagctgggccagggnctctgctccttcaaccacctgctgcncccnnagtgcatcaggacattgcnggtgctggangacagggccctcacgcgnagcttccgggaggtgagcccaccccccgaggcgtgaggcggcgagtgtggccccatggtgtcccccacgctgctcgaggcgtgttcctccaggtggatgagctgttcctcgaagactttcaggccccgcccnacgagctcttccaggagtttgactaccagcccattgctgcagcgagcctgcccangtgcaccgtgccaggctncacgatggcaccgtggtggccgtgaaggtgcaagtcatngaatctgcggnaccgntttgatngcgacattcacaccctgnaacttctgctgnaccttggggtacttnatgcaccccancttnggctttaaatttgggtcnttcaanaa

SEQ ID NO: 7210 - DNA, 304 bp, Zea mays
  misc_feature (4)..(4): n is a, c, g, or t
  misc_feature (7)..(7): n is a, c, g, or t
  misc_feature (14)..(14): n is a, c, g, or t
  misc_feature (19)..(19): n is a, c, g, or t
  misc_feature (28)..(29): n is a, c, g, or t
  misc_feature (37)..(38): n is a, c, g, or t
  misc_feature (45)..(45): n is a, c, g, or t
  misc_feature (55)..(55): n is a, c, g, or t
  misc_feature (58)..(58): n is a, c, g, or t
  misc_feature (60)..(60): n is a, c, g, or t
  misc_feature (77)..(77): n is a, c, g, or t
  misc_feature (84)..(84): n is a, c, g, or t
  misc_feature (89)..(89): n is a, c, g, or t
  misc_feature (107)..(107): n is a, c, g, or t
  misc_feature (112)..(113): n is a, c, g, or t
  misc_feature (115)..(116): n is a, c, g, or t
  misc_feature (128)..(128): n is a, c, g, or t
  misc_feature (142)..(142): n is a, c, g, or t
  misc_feature (151)..(151): n is a, c, g, or t
  misc_feature (163)..(163): n is a, c, g, or t
  misc_feature (168)..(168): n is a, c, g, or t
  misc_feature (178)..(179): n is a, c, g, or t
  misc_feature (181)..(181): n is a, c, g, or t
  misc_feature (190)..(190): n is a, c, g, or t
  misc_feature (205)..(205): n is a, c, g, or t
  misc_feature (216)..(216): n is a, c, g, or t
  misc_feature (222)..(222): n is a, c, g, or t
  misc_feature (224)..(224): n is a, c, g, or t
  misc_feature (227)..(227): n is a, c, g, or t
  misc_feature (237)..(238): n is a, c, g, or t
  misc_feature (240)..(241): n is a, c, g, or t
  misc_feature (247)..(247): n is a, c, g, or t
  misc_feature (255)..(255): n is a, c, g, or t
  misc_feature (262)..(262): n is a, c, g, or t
  misc_feature (277)..(277): n is a, c, g, or t
  misc_feature (285)..(285): n is a, c, g, or t
  misc_feature (287)..(287): n is a, c, g, or t
  misc_feature (296)..(296): n is a, c, g, or t
  misc_feature (300)..(300): n is a, c, g, or t
  unsure (1)..(304): unsure at all n locations
gctncancactaanggggngggtataannaaaaaggnnggagggncctaaaaaanccntntatatcacattcccctncaacctntcccnattacctcaacaaccttnctatnncnntctatctacctnttttaatctccctntcaccattnatatactatccnctacnattccatctnntntcacattcnatccctaatacactntactacattcnattacntncanccttccaacnncnncttcanccctatcntcctatnctcacatacccttcntccttaananctaatcttnaaanccta

SEQ ID NO: 7211 - DNA, 347 bp, Zea mays
  misc_feature (2)..(4): n is a, c, g, or t
  misc_feature (6)..(6): n is a, c, g, or t
  misc_feature (16)..(16): n is a, c, g, or t
  misc_feature (40)..(40): n is a, c, g, or t
  misc_feature (56)..(56): n is a, c, g, or t
  misc_feature (59)..(59): n is a, c, g, or t
  misc_feature (63)..(63): n is a, c, g, or t
  misc_feature (70)..(70): n is a, c, g, or t
  misc_feature (73)..(73): n is a, c, g, or t
  misc_feature (79)..(79): n is a, c, g, or t
  misc_feature (81)..(81): n is a, c, g, or t
  misc_feature (86)..(86): n is a, c, g, or t
  misc_feature (99)..(99): n is a, c, g, or t
  misc_feature (107)..(107): n is a, c, g, or t
  misc_feature (117)..(117): n is a, c, g, or t
  misc_feature (126)..(127): n is a, c, g, or t
  misc_feature (159)..(159): n is a, c, g, or t
  misc_feature (188)..(188): n is a, c, g, or t
  misc_feature (208)..(208): n is a, c, g, or t
  misc_feature (226)..(226): n is a, c, g, or t
  misc_feature (233)..(233): n is a, c, g, or t
  misc_feature (245)..(245): n is a, c, g, or t
  misc_feature (250)..(251): n is a, c, g, or t
  misc_feature (254)..(255): n is a, c, g, or t
  misc_feature (259)..(259): n is a, c, g, or t
  misc_feature (265)..(266): n is a, c, g, or t
  misc_feature (270)..(270): n is a, c, g, or t
  misc_feature (273)..(273): n is a, c, g, or t
  misc_feature (276)..(276): n is a, c, g, or t
  misc_feature (286)..(286): n is a, c, g, or t
  misc_feature (289)..(289): n is a, c, g, or t
  misc_feature (296)..(296): n is a, c, g, or t
  misc_feature (298)..(298): n is a, c, g, or t
  misc_feature (306)..(306): n is a, c, g, or t
  misc_feature (313)..(313): n is a, c, g, or t
  misc_feature (318)..(318): n is a, c, g, or t
  misc_feature (328)..(328): n is a, c, g, or t
  misc_feature (334)..(334): n is a, c, g, or t
  misc_feature (336)..(336): n is a, c, g, or t
  misc_feature (341)..(341): n is a, c, g, or t
  misc_feature (343)..(343): n is a, c, g, or t
  misc_feature (346)..(346): n is a, c, g, or t
  unsure (1)..(347): unsure at all n locations
annntncttgaacccntcgatgccgtaccgggccggaatncggtcgaggcacgcgncgncacncgtccgncanttcctncnctcgngagctcagctcgngcaccggngcgggcgggnaatgagcanncggaggaggagctgtgccaagccacaatgggnatctcgcgtgactcgatgcacaagcgccngggccaccggtggaaagcanaaagcctggaggaagaancgaaagnatgagcttggtnggcanncanncaanaccaanntgtnaancantaagacaagngangagggtncntgttccgnggagggnaaagngaaatggganaggctntnttccntnatna

SEQ ID NO: 7212 - DNA, 505 bp, Zea mays
  misc_feature (2)..(11): n is a, c, g, or t
  misc_feature (16)..(21): n is a, c, g, or t
  misc_feature (23)..(23): n is a, c, g, or t
  misc_feature (32)..(33): n is a, c, g, or t
  misc_feature (36)..(36): n is a, c, g, or t
  misc_feature (42)..(42): n is a, c, g, or t
  misc_feature (430)..(430): n is a, c, g, or t
  misc_feature (438)..(438): n is a, c, g, or t
  misc_feature (492)..(492): n is a, c, g, or t
  unsure (1)..(505): unsure at all n locations
gnnnnnnnnnnagggnnnnnntntgaaacttnntgnaatgcncgtaccggtccggaattcccgggtcgacccacgcgtccgggcggtggcgcctcagggcctgccgcccctcggcccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctncggctaangatatccaatgcatgcgcttcttgcgaatcgtcatgtaaaatcaaggtgtctgnctataatctagcc

SEQ ID NO: 7213 - DNA, 543 bp, Zea mays
  misc_feature (3)..(8): n is a, c, g, or t
  misc_feature (10)..(11): n is a, c, g, or t
  misc_feature (16)..(21): n is a, c, g, or t
  misc_feature (23)..(23): n is a, c, g, or t
  misc_feature (25)..(25): n is a, c, g, or t
  misc_feature (28)..(29): n is a, c, g, or t
  misc_feature (328)..(329): n is a, c, g, or t
  misc_feature (332)..(332): n is a, c, g, or t
  misc_feature (336)..(336): n is a, c, g, or t
  misc_feature (340)..(340): n is a, c, g, or t
  misc_feature (347)..(348): n is a, c, g, or t
  misc_feature (351)..(351): n is a, c, g, or t
  misc_feature (353)..(353): n is a, c, g, or t
  misc_feature (355)..(355): n is a, c, g, or t
  misc_feature (359)..(359): n is a, c, g, or t
  misc_feature (362)..(362): n is a, c, g, or t
  misc_feature (368)..(368): n is a, c, g, or t
  misc_feature (373)..(373): n is a, c, g, or t
  misc_feature (379)..(379): n is a, c, g, or t
  misc_feature (384)..(384): n is a, c, g, or t
  misc_feature (390)..(391): n is a, c, g, or t
  misc_feature (396)..(396): n is a, c, g, or t
  misc_feature (400)..(400): n is a, c, g, or t
  misc_feature (403)..(403): n is a, c, g, or t
  misc_feature (405)..(408): n is a, c, g, or t
  misc_feature (411)..(411): n is a, c, g, or t
  misc_feature (417)..(417): n is a, c, g, or t
  misc_feature (427)..(427): n is a, c, g, or t
  misc_feature (431)..(431): n is a, c, g, or t
  misc_feature (443)..(443): n is a, c, g, or t
  misc_feature (445)..(445): n is a, c, g, or t
  misc_feature (448)..(450): n is a, c, g, or t
  misc_feature (457)..(457): n is a, c, g, or t
  misc_feature (462)..(463): n is a, c, g, or t
  misc_feature (466)..(466): n is a, c, g, or t
  misc_feature (469)..(469): n is a, c, g, or t
  misc_feature (473)..(474): n is a, c, g, or t
  misc_feature (476)..(476): n is a, c, g, or t
  misc_feature (478)..(478): n is a, c, g, or t
  misc_feature (484)..(484): n is a, c, g, or t
  misc_feature (490)..(490): n is a, c, g, or t
  misc_feature (498)..(498): n is a, c, g, or t
  misc_feature (501)..(501): n is a, c, g, or t
  misc_feature (505)..(506): n is a, c, g, or t
  misc_feature (508)..(508): n is a, c, g, or t
  misc_feature (510)..(510): n is a, c, g, or t
  misc_feature (513)..(513): n is a, c, g, or t
  misc_feature (520)..(521): n is a, c, g, or t
  misc_feature (523)..(524): n is a, c, g, or t
  misc_feature (527)..(529): n is a, c, g, or t
  misc_feature (531)..(532): n is a, c, g, or t
  misc_feature (540)..(540): n is a, c, g, or t
  misc_feature (542)..(542): n is a, c, g, or t
  unsure (1)..(543): unsure at all n locations
gtnnnnnngnnagagnnnnnntntngtnnctcttcctttccgtaccggtccggaattcccgggtcgacccacgcgtccggacgaccactccctccacaacgccttcagcacctacggcgaggtcctcgagtccaggatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggnngcngcangctnctgtaannccngncngccnttnatgctngtggnctgctncttangtgggnngaagntacnggnannnnggnaagttnctgggagttngatnacggtttattantnttnnnggcaacntttgnntgnagnttanntnanttttgnatcggnaattggangancttnngntnttnggacccnnanntgnnnanntttttttntnc

SEQ ID NO: 7214 - DNA, 419 bp, Glycine max
gacagtgttcacagacactggaagcagcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaagctgccgcacatttgaagggtggtgccaagaaggttattatttctgcccccagtaaggatgcccccatgtttgttgttggtgttaatgagcacgagtacaagccagagcttgatactatttccaacgctagctgcacaatcaactgccttgctccactccccaaggttatcaatgacaggtttggcattgttgacggtttgatgacaacggttcattccatcactgccacccagaagac

SEQ ID NO: 7215 - DNA, 300 bp, Glycine max
tgtaaatctcaagatcagatcctcatctaccaccattccaggtgtagccatcaaaacaacgtttgtttaacaaaacccattatcagatcagatccgatcagatcctcttcagattcggatcaccgccgagtccatgagcacgccagcgctttcagggggcacgggcctcttctctggattcacgcgtttatgcaagggccttgcggtggtgcttgtttgcggtcacattgcggttcagtttatcccttcagctgttaactatcttgctcttattcccgccaggacaatcccatttgcctg

SEQ ID NO: 7216 - DNA, 390 bp, Zea mays
ctagcagccgcccttagctccctcgactcagatctcccttcgcagccgccgaggggcggcttctcagagcggaagatggctgaacaggatgccccagtcgcggttgaggcaccaaccccagttcttggggagcctatggacttgatgactgctctgcagctcgtgatgaagaagtcaagtgctcatgacggtcttgtgaagggtctccgggaggctgccaaggccatcgagaagcacgccgctcagctttgcgtgcttgctgaggactgtgaccagccagattacgtcaagtttggtgaaggcactctgcgctgagcacaatgttcacctggtcactgtacctgccgctcagactcttggctagtgggccgggctttgcaagattgactt

SEQ ID NO: 7217 - DNA, 326 bp, Zea mays
agacacatgtgacaagcctcatctcagccgtgcaggaccaagtagttttgcttcactccggcattccatccatatccatccatcagaattctcagtctccacagcagcaaggcgcacgaccagcaccagcagccggcaacaaaagacacagcagcgatggcgttcgtgccggtgtgcgtgcagtgcgggacgcggagcaacccgtgccggtgcaaggtggtcgggccgacgctggggttcgtcgcgttcgtggtggccggggtcatcgaatggccgctgggggccgccgtgtacctgttccgccaccgcaagggacgacgcatcat

SEQ ID NO: 7218 - DNA, 357 bp, Glycine max
ctagaacttcatttttctctccctcgtcactaacttgagcgggtggcttgttggtaaaattagtactcaaatcggggttcatgcaactgctgcaaagtggttcaacctctttacaactcagtcttattatgttcaacatcttactgatagattgcatttaaccaaacttcaccaccgagaaaagtcacttttcaactagtccatcaaacactcatactttacaacaaatggtcagatctcaacatcttttatagagtaccaaattctttaatttattcctcaaaacaatcactttcagcctttttttactatatatccttatttatactaattttttaaatttattttctattcttt

SEQ ID NO: 7219 - DNA, 364 bp, Glycine max
gaaagattttatccaattgaaattttaaaaatgactgggataaacttaagaattcaattattgaaattgaataagtaaacaatttaattggattggtcgaatggtatcaaaaaaatggagtactaactcccatttcttatttattattgaattaaccgatcaacttgctttgttatcgaacatttctttttgatttcaaaaattttccggaaaaaatttgaatctatttttatatgcgaatcaatcctactacttctggtcctgaggtttctgcgcttgaaaaaaaaaatctgggacgtatcgcccaaataattggtccggtactagatgtagcttttcccccaagtaagatgcctaatattta

SEQ ID NO: 7220 - DNA, 392 bp, Glycine max
gataactagaaacagtgtgatgaaaatgaaggtccttgttttcttcgttgctacaattttggtagcatggcaatgccatgcgtacgatatgttccctctccgaatgaacactggctatggtgcccgtactccggaggtgaaatgcgcaagttggaggcttgctgtggaagcacacaacatctttggctttgagaccattcctgaagagtgcgttgaagcaacaaaggaatacatccatggcgaacaatatagatcagactccaaaacagttaaccaacaagcttacttttatgccagagacctcgaaatccatcccaaggacacatttgggttcagtatagatggcaccgtactctctaatattccatactacaaaaaacatggatatgggg

SEQ ID NO: 7221 - DNA, 261 bp, Zea mays; identical to SEQ ID NO: 7110

SEQ ID NO: 7222 - DNA, 134 bp, Zea mays
  misc_feature (8)..(8): n is a, c, g, or t
  misc_feature (36)..(36): n is a, c, g, or t
  misc_feature (41)..(42): n is a, c, g, or t
  misc_feature (53)..(53): n is a, c, g, or t
  misc_feature (55)..(55): n is a, c, g, or t
  misc_feature (57)..(57): n is a, c, g, or t
  misc_feature (73)..(73): n is a, c, g, or t
  misc_feature (79)..(79): n is a, c, g, or t
  misc_feature (82)..(82): n is a, c, g, or t
  misc_feature (101)..(102): n is a, c, g, or t
  misc_feature (126)..(126): n is a, c, g, or t
  misc_feature (130)..(130): n is a, c, g, or t
  unsure (1)..(134): unsure at all n locations
cacaaaantgcccagaagcatttgaacgtttagggntccgnncccctagaggntngntaatgataggaccgcnaggttncancaagactttgatggctcgnnctgcagcttctgaagcaaaattgnattncctg

SEQ ID NO: 7223 - DNA, 432 bp, Zea mays
  misc_feature (11)..(11): n is a, c, g, or t
  misc_feature (255)..(255): n is a, c, g, or t
  misc_feature (281)..(281): n is a, c, g, or t
  misc_feature (341)..(341): n is a, c, g, or t
  misc_feature (350)..(350): n is a, c, g, or t
  misc_feature (353)..(353): n is a, c, g, or t
  misc_feature (358)..(358): n is a, c, g, or t
  misc_feature (362)..(362): n is a, c, g, or t
  misc_feature (389)..(390): n is a, c, g, or t
  misc_feature (402)..(403): n is a, c, g, or t
  misc_feature (406)..(406): n is a, c, g, or t
  misc_feature (421)..(421): n is a, c, g, or t
  misc_feature (425)..(425): n is a, c, g, or t
  misc_feature (428)..(428): n is a, c, g, or t
  unsure (1)..(432): unsure at all n locations
ccacgcgtccngacacatgtgacaagcctcatctcagccgtgcaggaccaagtagttttgcttcactccggcattccatccatatccatccatcagaattctcagtctccacaagcagcaaggcgcacgaccagcaccagcagccggcaacaaaagacacagcagcgatggcgttcgtgccggtgtgcgtgcagtgcgggacgcggagcaacccgtgccggtgcaaggtggtcgggccgacgctggggttcgtcncgttcgtggtggccggggtcatcgantggccgctgggggccgccgtgtacctgttccgccaccgcaagggacgacgcatcaatggngcaaccggncancgttntgtnaccgcgcctttacaaagggcaaccccnnttaatcgggcgnncgngttaaccaaggttcngggnttnattt

SEQ ID NO: 7224 - DNA, 460 bp, Zea mays
  misc_feature (49)..(49): n is a, c, g, or t
  misc_feature (400)..(400): n is a, c, g, or t
  unsure (1)..(460): unsure at all n locations
atttggtagccctgcaggtacaagtccggaattcccgggtcgacccacncgtccgcccagcgtccgggcgcgatcactgcgcgacgagtacaacatgcccgacaacgccctccgctgcgcaaggtcgtggggctgccgctgccgccgtcctacgcccccgcgcgctaagacgacgaagcctcgttttctcctcgtggtctgaccatccaatccaaactcaaaagaacaaatacgaagaagcgtagtgaaggggaacaaatgaatggatatatgtaatcttgagatgcatgccctccaaatcactgtactggggttctcaaaaaaatcattgtaatgggagttatatatataacttatctcaccaaagaaaaaaaaaaaagggcggccgctctagaggatncaagcttacgtaccgtgcatgcgacgtcatagctcttctatagtgtcacctaaattcaat

SEQ ID NO: 7225 - DNA, 461 bp, Zea mays
  misc_feature (3)..(5): n is a, c, g, or t
  misc_feature (7)..(7): n is a, c, g, or t
  misc_feature (50)..(50): n is a, c, g, or t
  misc_feature (380)..(380): n is a, c, g, or t
  misc_feature (405)..(405): n is a, c, g, or t
  misc_feature (440)..(440): n is a, c, g, or t
  unsure (1)..(461): unsure at all n locations
ttnnncngccagtaccgggtcaaagaattcccgggtcgacccacgcgtcngggagtcttgacgacgtcaatagcatgatgcagcaacaacagcagcaggcaccacccgtggtgcagcacagcagcagcagcagttcttcatccgcgacgacacgccattcatgagccagatgggcgaatcaccagcacggcggagttcaggttcggctctggtttcaacatgtctagcaccgccgcgctgattacccaggcgcggcgcagaagaacgacggggccaattggttctactgaagaataaacttgtagggctcctcgttataagcttcggattcctccatggctctcccaaagttgtaaagtccttaaaagtccttcggtaanaaaaggttttgcaattactgcaaanacgggttgaacctggaaactggtttaaacttgtangttccgggccagccataaacc

SEQ ID NO: 7226 - DNA, 448 bp, Zea mays
  misc_feature (261)..(261): n is a, c, g, or t
  misc_feature (263)..(263): n is a, c, g, or t
  misc_feature (312)..(313): n is a, c, g, or t
  misc_feature (317)..(317): n is a, c, g, or t
  misc_feature (323)..(323): n is a, c, g, or t
  misc_feature (327)..(327): n is a, c, g, or t
  misc_feature (332)..(332): n is a, c, g, or t
  misc_feature (336)..(336): n is a, c, g, or t
  misc_feature (348)..(348): n is a, c, g, or t
  misc_feature (408)..(408): n is a, c, g, or t
  misc_feature (419)..(419): n is a, c, g, or t
  misc_feature (421)..(421): n is a, c, g, or t
  misc_feature (425)..(425): n is a, c, g, or t
  misc_feature (438)..(438): n is a, c, g, or t
  unsure (1)..(448): unsure at all n locations
ccacgcgtccgcccacgcgtccgatcggggcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcngntgctggcccgtggacgaccggttcctgcgggagcgccaaccggggctgnncgtnctgggnccgngcgtngtcnacaattgttacnagaacaagttactgggaagaatgcttccaattactaattcgaacaaggaccaggactacnacaacaacttntntttntgggggttgttcntggacaacaa

SEQ ID NO: 7227 - DNA, 472 bp, Glycine max
  misc_feature (39)..(39): n is a, c, g, or t
  misc_feature (427)..(427): n is a, c, g, or t
  misc_feature (443)..(443): n is a, c, g, or t
  unsure (1)..(472): unsure at all n locations
ttcccttgcctgctcctataaaagaacaatgacctcgcntgcacgcgtacgtaagctcggaattcggctcgagttttgatgcatgtaagtggacaaaatcggaaccacattcctgggaattgatcttcccaatagaggtatgcggtcctaataatggttttgaaatgtggagttctgagtgggcaaatcaaacttcatggcatttgagtttccttattgacaatcccaaacagtctacagtttttgacattctcttgggaatttctcaagattttgaaattgctggtaatactcttatgccagctttttctgttccacaggctactgccagatcttctgaaaatgcggaatcctctgcatgatctggaatttgtgttttctttcatttgtccgtttgtttaattcaataaaggaaattaggcatgancctccttgttgagtangctctgcctatttgaaaaatttcacacct

SEQ ID NO: 7228 - DNA, 124 bp, Glycine max
  misc_feature (74)..(75): n is a, c, g, or t
  misc_feature (85)..(85): n is a, c, g, or t
  misc_feature (87)..(87): n is a, c, g, or t
  unsure (1)..(124): unsure at all n locations
taatattttattcacttaaataaagcgcattactatgtgcaatgagtgtgtttaaatataaaaaaaaaaacaannaaaaaaaaananaaaaaaaaaaaaaaaaaaaaaaaaaaaaaaaaaaaaa

SEQ ID NO: 7229 - DNA, 444 bp, Glycine max
  misc_feature (225)..(225): n is a, c, g, or t
  misc_feature (237)..(237): n is a, c, g, or t
  misc_feature (268)..(268): n is a, c, g, or t
  misc_feature (287)..(287): n is a, c, g, or t
  misc_feature (308)..(308): n is a, c, g, or t
  misc_feature (333)..(333): n is a, c, g, or t
  misc_feature (335)..(335): n is a, c, g, or t
  misc_feature (337)..(337): n is a, c, g, or t
  misc_feature (339)..(339): n is a, c, g, or t
  misc_feature (342)..(343): n is a, c, g, or t
  misc_feature (356)..(356): n is a, c, g, or t
  misc_feature (360)..(360): n is a, c, g, or t
  misc_feature (366)..(366): n is a, c, g, or t
  misc_feature (374)..(374): n is a, c, g, or t
  misc_feature (385)..(385): n is a, c, g, or t
  misc_feature (388)..(388): n is a, c, g, or t
  misc_feature (393)..(393): n is a, c, g, or t
  misc_feature (398)..(398): n is a, c, g, or t
  misc_feature (426)..(426): n is a, c, g, or t
  misc_feature (437)..(437): n is a, c, g, or t
  unsure (1)..(444): unsure at all n locations
tcgagggaaatctttatattttgtaaatactacaaaacacaaggtactacgttcggtgttatgttggggaataaaagaaagaagtaaagattttcacaatgaaggacacctccaccagcgttgaccgcgacaaggaagggagttccagtggctccggtaaccacatttgggtgatgagaaagggtcatgcaagtcaccatgttccttgctgggcctgccgtgttntgggtggttccnctaaaacactgcttccccctttgggaataantccctggccctcctcacanagcatccatgctcaattcatncaaagggctaaattatgattccaanancnancannagtgttccttaanagancccatncaatgaanggattaagacnagntgatnatccncaacctttaaaatgaatgccatggggcnaaaacccaagntttccag

SEQ ID NO: 7230 - DNA, 418 bp, Glycine max
  misc_feature (353)..(353): n is a, c, g, or t
  misc_feature (366)..(366): n is a, c, g, or t
  misc_feature (391)..(391): n is a, c, g, or t
  misc_feature (413)..(413): n is a, c, g, or t
  unsure (1)..(418): unsure at all n locations
ttctcagttagtgtaagcaaatcagcaaatgagattgttgctacttataccaaggatgaaacgggaatggatctagtcattcgtctccctgcatcttatccactaaggcctgtagatgttgattgtacaaggagccttgggattagtgagaccaagcaacggaaatggttgatgtcaatgatgctatttgttcgtaatcagaatggagctttagcagaagctataggaatttggaagcgcaattttgataaagaatttgaaggtgttgaggagtgcccaatctgttacagtgtaatccacaccacaaaccacggtcttcctcggcttgcttgcaagacatgcaaacataaatntcattctgcttgnctttataaatgggtttcaacttctnacaaatcaatcctgcccattgngtcaa

SEQ ID NO: 7231 - DNA, 426 bp, Glycine max
  misc_feature (239)..(239): n is a, c, g, or t
  misc_feature (261)..(261): n is a, c, g, or t
  misc_feature (389)..(389): n is a, c, g, or t
  misc_feature (392)..(392): n is a, c, g, or t
  misc_feature (414)..(414): n is a, c, g, or t
  unsure (1)..(426): unsure at all n locations
cacgcgtcaagctgaaccacattatcaagtctacaaatatgaagtgcctgactccaccatcggcattggaaggggattgtggattccttgctgcaaacctttatgctaagagtgtttttggggaagatgctttggtgaatgtgagcattgaaaagcaatcaaatggtaagttgagtggatacatcagaataagaagttaaactcacggaattgcctcaagtcctggggataagataacnttgaaacaaaagggagccgccntaataagagtaaatgcccgttttctctgatgtttcctcgcctaaatcaactttgtgtaacttccttgtggcgggctaacttcaagcttgggtaatgcttcaaattctgcggcttttggtggcaacccnccntgttaagaataaattttttttncccttttgaaat

SEQ ID NO: 7232 - DNA, 127197 bp, Glycine max
aagcttgaacagtatatggattagccaccatgttgaaaggcacgtaaggccaaatctcagcctttttccctgttgacttggccttctttaagaccttgtttggttccacataaccagttactgttactttctgctgcttcctgtttatctccaccgattctactcctacacttacaccaccattttttagttaatttcatcaccttcatacgtgttgaatgctatataattaatatatcacactattaattttcaccaaaagaaaaatattacactattaattgataacatactctctaacacttttgttttaacatattatttattattaattaaaatttattgaaaaccataaattataaattataagtgaaaccgtaaaataaagagtcatatcaaacattttttgtgattttcaacaaattttaacataaaagatggttgtgctagctttttttatatatattattataattataatatggcacactacccatggaagctgattttgagaataaaattgagggaaaacgtagcacttaccatctaatgaagagagagttttcctaaccttgagcacacagccgtcacaatccatcatcaccttcagctccacggtctgtaattgcttcttgttcttgttcttgttgttgtgttggtggttgccattcccacttcccattaaatcagaccagtaatctccaacccccatttttgtgtatttaatatcaaaaccaatatgaaagcaagctgggaagttcttgatgagtagagaaaattagtaggtattagatgggttgaacatcattgatggtgtgggagcgtaggagaagaatttatatagagaaaaagcaaggtccaaaaccacaagaagttacaaggaactttcttgcaaaacagaaaaatattcctcactcacttaccttctaatgatctaaaaaccaatgctgctctttgaagaacttttttttagttaccttgggatatttttaccacatctaactaaaattgattttggtagaagtaaaaattaatcttatttgttttaattttatcataattttaaaaataatttaaacgtacaaaatttagttaaaatcaagattaattcacatcagcatagtctaccagaattttgaaagttattcacacaattatatataggctttttcaccattcagattcaatgatatgaatggaaaggtatagtggtccctaactacgccagtgaataaagaaccttagaacggattataacttcttaacggagaaaatttttacgtggggttcaagaaagtagataagaaggaacgcattcctgtatcacctttttcattcgcaaatatatatgtaaatagtaaaaatttatggtactgcttgcggttcagttgacacttgacaaagttatttatttgatatgtaaaaagaaatggacatatcaaatgacagctaatactgagaactctcttattgaagagcaataatttattgaggacgaaagtgaaagactgaaagcagcttccaccgactcatgcacatatccgatcgaatgaacaacataatgtggaacagataatgacggggattgtatttgaagtgatgcaagtgcaagcatttagcaccattgacaaagataatccttcatattgcaacggctatgagccttttaccctctccattgataaaatttcagtcaacttaaggccaatcaaactcacaaatatatgtcaagtttgtactttgcaaaaagataataaggaaattatctatcaaactaaaataaaattcacaaaatcatcattccttagccagactcatgatccaaactcatatttttaattaaatttcagtcttctaacattaaggagttttcccatttttcttgattttaaaaagaaaatatttcaatcgtctctcttagcgataccctttggactcgttgtgacaatattcataacactttctcctaaaatctttcgacctttcactataaatacttgttaatgttatctaaaagtatgaagcattattttgtaagcaaattcttttagcttagtcacgaagaagttattggaagtgtcataattaatttcatcatgcatggttcaagaattccattagacaaagaaaattgtctcagtagttatcatcgataacacaagctactagaccaattgaccaaagaagtttcgtcttttaaattcttttcccatcttgtttgaatatgagatatttgattctcattgatactttttcgataagataaaggtgacattttggcttctgtttctaagatatttctataaagggaaccaaaagaagcaatttgaatcattaatttaactaacccactaaataatctttttttcaattagcaaaactgctgaaagctcagtcccacttttggaaaacaaaagtagagtgataaggaaaagataaaaataagaaaatgcaacgaaaagtgtgggtgagaacagaaaagagaagcatgcgtcaggataccaccctaaactaaagtatgtgcttaagttttgaagtaccggaggtatacaccaaaggcttagtttcatttgcattaacatattaataataattcacaagagaagaaatataaaataagataaatcaattttttcacaagttaaattttattttattttttggaatttttacaagaaataaaaaaattcataacttaaaattaactcatgtatgataactttttaatagtttttttgtttaattttcctaaaagataaggcgtataaattaattttagtttacgagagaagttggatttgtttatttcttatattaagtgccttgtttagaaatttattgaaagtgacccaaaatcaattatatgtggatttaaacacttcaaagctcgctgaaactgaaagcatttcattcaaaagtaaatttaacgttaatgttcccctgattagttgagaaaaggacatgaattgtactagtattaatttacctcgagatcaaagagagcaaaaagtttaatcatactatatttacgcagaaaaagatgataaacaagtgtatagtacagacgtgagacgtggaataaaactttgattagtaataaattggtcattgttgcttttagaaacttgctgtggacacacatgacaaaagggatttgcatttttatgaagctcgtctcatgtttaaactttaatttggacggaattgaaaaacatctcattgatatattcatgtgctttcttcttgctagcttttggattgtagatactctttgattatcataaaaggaacgaacgactttaatttggaaattgagaccgaagttgcaatagaaatcgttacacgtcttctctagtgtgtatgtattgtttccttttgggtttaaaggatgaccaaatgttgaggccagtcacaatataaagggaactcacgaagctggggaaagtgtttagtatagtttaatgtttaaactcatgcacgcaccagatatcttaagaatctataccagatatataacggttgtctatatagtttctttccattcccattgttggagaattaaagcttctgattatttagcatattttattgtataattttactatatagtattttgtactttaagtatcttatcaaatcttcggttgcaacatcattggagaagatatagtggcattcataatgaatacaagtccaatgaattcactttatgttgtcaactagtagtccaatgaattatgttgtggttggcttaagaatgaatacaagtcaaatttcagctggcttacagtcacagtggcatggaatatataacagagtgttgcgtcaaaaaaacaataatgacgacaacaggactaaatacaatgcatgtattttttttttaattgagaaataatttattctttaaagttctctaaaaaaagtaacattttactaataattttccccactcgaattgagggtattaaagtaattttcattgtttttgcttttattttttatttaaaaaacatttgttcagttaatgagattaatgaattttgtcacttttgggtaacacatgtaaaattgaagacggatgcagaaacaaacacctactaaatgacagtatatgaaacctttatatcaagtacatatattattttctcaattttctttaactttaactcattaagccaatcgatctattacatctcttactttgatttgatgtttcacttatcattaattaaagataaacaatgtattacattttcttaactaaaaattagcatctaagacatatatttttgtagttcattttgtcatgaaaaatatgggtacatcatccgatacaattactaaactaaactaagggaagaattattctcacttttatatttgttatttaaactatcaattctgaaatttctattttgcccactaaccaaattcctccaccccctctcttttcccttccctccttctcatatccaaaaccgttgcccctacaccaacctagactgcatcacccctccctcagcgccacccttctccccacacaaaacgtcgtcaatccacgaccacgccatccctccctccgcaacccattgtcaatccacatgcatgccatcctccccctccatgcaattcgttgatccacacagcaccttgccccatcaagatcaagcacccttgtttctcttttttggattttattgcaggttttgttgttgttgaatcgtatttctgttgcatcattttttacacgctactgtctgtaatggaaatagaatgaaatcgtatttcttttgcttttttttctttaccccatgtgtgcaacgaaaatagaattttgttagagacttatttaacggagtcatattttcgtgggaaggacaagctaaaaaaaaaatatttgaaactaagagggattgtgccaatagcaatattggtattgctagttcccctgaactacataaaaccttcctcgtattgaaatatgcttaattaaaactttcatacctgaaatatgggtgtcttcaaattattagctaatatttattttttttaatcaagtagttgaaaaaaaaattcagtttcattttattatttatttatttttcatcaagtggtaatatgacatacggagtgttgcctcaacctgtcttgttatggataactcatactcatgttatcatcttcgatgattgtgacaataacatgttggtaaattgaaacataaaaaaattttagataactatttgacaaaaaatgaatttttaggtagtaatttgaaaataatttattttccaggtatgaaaaacttaattaaatcaatctgaaaaataattttttagctaacaaatgataaggagaaattttataaaaataaataatttaatttcaaataaaatgataaattttattatttcattaaaaataaaaataaaaatggtaatcataaatttaagttatgtttaaaagtaaatcttataagtcaataagaaaaaattatttctcaaacacttttatttgatcaaatatttgtaagtttgtgtaaaaaactaaaaattaattaaaataacctgatgagcatatatgtaatttacttttatatagacttaaaaaactttatctttttttaagataatttctcattcaaaataagaaatacattaaattaatgagatatttttttatttgtagaattaaaaaaagtactatttgaaattcacaataacacttatcaatttatcatatttaatcagctgaactaaattaataaaataatattaaagattaaattaaaaagttgagttacatacattgaaccaacaagatcaaacactgagatatatattttggatccagagaataataaaggaagagtgaaggaaggcataacatgttacatacattgaaccaacaagatcaaacagtgagatattaattatttattgtttaaataaatttttaatacctgaaaaacatatcatttttaaattattacttaaaaaatcatttttttcaaatacctactagaaaaaaaaatttagttttattttattatgtcattaatcataatcacgtccactcggtcatatgtcattgaaagtgataacgtaacaataaaatattcgtgacaaggtgtgatgacgtaacattttgtatgtcacattatcatttcactaaagacaactaacaacaaataataaaataaaattgaattttttttaaaatacttaactttaaaaaataaatattaaataataatctaaaaatgatctgtatgtccattatcaaaaatttaagtaagccgaaatataaccttcttattcagtcattgtggattcgctaacaactcgtgctgatcgagcctatagtaattagctctcttagctagaaacattagcccctgattatcaatatgatgttcttgcacaaaacgacaaaatgatttcatgatttttagataaataagcgcaggattctctattattcagagcaattaaatgaacgcaattacgaggcagcaaatgcaaaatgcttcacatgaggctattggctatttaaaatttcactttgacatttttataattaattttgtctcaataattcgcatgacaattagcattaaaggttagctaaaactctaatttaaattgttacaatattttaaaaaaaactgagaaacatgatttaagttttgttattatatcaaatactactataaaatagaaaaaacttacacccttcaaatgtactagattcggattttttttatagaaaatattttaaaattaaatgtcatactcaacagtcaacacggtatttcacagtcccctagaatttcaaacaaaatcaaccaagtaacataaattagttgactgaaaaaatgaattaaattaaaaggcagtcatgggataacaccaggcatattaatttacataacctcacccgagcaaaagcgggtttaacagataatggtccagtacgtgttaggaatctaacatgctggcaatgtcaaaaaaataacagcattggatggtgtaagatctaaaatacttacaaagctaggaggaggacaaaatggatacatatttggatgtacatgtaataactctatctagacaggctagttgagatacataagaataagaacgtgtctgtctcagtaaagggcagacacaagtagaagtagaagaaacaaatagcagtgccaatgtacccggcacgatgaaatcatccgagatggagcagccgaaggtttgtggggagctcttccagcaacagctggagcaactgcatgcccgttcgttctttgttgctcatctgtaggcaatgggtttgatgaagtctcatttggagaaaggggcatcctcttgcctagactcagatcctgacctacagatgcatgtagactgtatataagcaaaaggaataaaaagggagacgggaagaacagtgttaaggtagaaaaaagcctttgcatcaagcaccaggcaaatggttaagagaccaagaactcacaagaagtcagcttcattgcctaagtagaatgattagaactaaagctaaaatatattagcttataaactcaaagtactatgactcacaatttgagcgtgaccacgctagcttcttgtttcccctatcaaataccaaacggtatcctgtcatgaagttctctgccaaaaaaatttattagttttaagatcaaagtatcttttaataccatattccagagtatgggtaatcagtagactttgataaggaaaatatttaacttacgtccgattgttcccatatctccttcagttggctgtatggctaaacaaaatccaatgactccctgcacaggaaggaccgatctaactaatttagctacaagccgacaactattcttataatgaagtctcttgtaacatctttaattatatgtcaaaattttagtccaggatcacttaattcacacccacctcattgccatagaatacaaatacggggtcatagaccacaaaactgttattctgttggaacgtgagagttaagctgggaacctttggcaactcttgcgaactgtctcagaaaagaataataaataaataaagccatcaaagagaccagaaaattctaccaattaggaaatcatgcaccaacgcaagagggaagagagacagagatctatccagaaaactcacctgggaacataacaatactcccaaggagatccttcaaagctagatcttgaaccatttacttgttgatcaaactatcacaaataaaatcatattaaaagactgagcagaaatttacattaatggaatttagaaaactaaagtacctcctcagctattgctccatacacatgaccaggaagaaaagtaaatgatgtcccgctatcaacctgcactttaaaacttgtcattttaagacaagaattcccaacacaacatgactccactccaataatgtaggttgaactgaccaggaaatttatcataattagcactgtgacaccattttctaaagtatattttagtgcagtgaaacattgtaaactaatttaaagtacagaatttcatactataatccatccaaaggcaagaatgaagtagactgttggatggttggtccctggtccccaaaaaatattctaccagaatcatcttcattaaagcacaaggaaaaagaatcgtggattaatcctgatttagcaagaaaacttggaactgaactctccccaggccccaaacctaataggccatctggagcaaccccatccaaataaccaccactttgcttcataccacacctgcattcaacaaaactgacgtcagagaaaaaaccaggaaacttgtttttaattaaaaaaagaatacatcatcagggaaagtgatgttgaagtaacaaagacagggcagtcagccacacccaagaacaactggagcctgaacagatgagtttgataaactgccgcctgactgaagatgcagtatgtcctcaaccaacaatccagaactcgacgtgttctccgacaagtaactgaccatgtatggacactgctgctgtgaacttttacaattcgaacccttatcacacaactgatgactgcaagatagatgcttactggataaggaccgagacggactatactcattcagatctctatcctgcataatagatgccccatatgtgaaggagcacctgccaatcaattactggaaataagtgctaaacctgttatagattctaaacctcattgaaccattacactcagaaaggaaccatgttttgtgttagtgtcacattaaactcgaattgaaaccttatccaatcaaggatttgcaattcgcatgattaactatttgttaaacaatcaataaaacaagctaatataatccgatattttattatttttattacatttaagatattgagactacaagttacatagtagagtaaaccaacattttagttcctgaaagtataaagcctagtcacataaacattagtccccaaaactaagaaacttcaaaaaagtccctgaagctgcaatccgccaatcgcattaatccaaagttataaaaaaatatgtgacttaatgataatattatcatatgtttaagagaccaaaatctcaagatgaaacaactagaaactccctggactaattttaaattttccttagtttgaagaactaatgtgacacctcgttatgcttaatcatagtttactctacatagtaagagaaatcaaagaaaaaaatagattaggtatgatattcataccagattggaatagtaactcgatgacaatggagcacactgtacgcaatcacacggaatccaaaggagatcactccctgcgtccaacgccacgagaaacgaagtgctcggtgttcctatatcaatccacgtgtaatgcaacctaatcaccagagacgcattatcagattcaaaccgaagaaaagggagcaattagggattattattattattattattattattaccagccgaagtcgttgccgagcgacatcgttttgctaccgtgagaaggaaacagtagctggtagcgtgcgcctccgactttgatcttgcgccggagaatgtcgccggtgagaagcatccggtagtagcccatgctccaccggtccggccagtatccggtcggaggccgaaccggtttcatttcgtcggcgaagcggtgaacgaggcgggcggaaaacgtgatcggaaccggcattgcgcgagccgttaccaaaagcaacaaaagcagcaaccgccaccgcatcgagatcgagatctggcacttgcacttattctgatgcctcgttttaactgatttaagtaacgattagtgttaattagtgaggtgagggtgcgcagtgtgcatcatcatcgccatggatcgtatcgtttcgtccctgtgtggctgtgtgtgagtgagagtgagagtgagagtgagggtggataaaacaaacaaacaaaactagcgcattttgttgcgggtggaattagactgttactaagtgcttaattaatggggaaaggaaagtggtatgattagtgtttgtaacagtaagtgattattgtaaatgatgattaggaggaataagggtgcaacactgcagcgacgaagcgaaacgtcacgcgcggtggccccaccatgtctttacgtgcttgagaatgaaacggccttttattgccgatgtcgatttgtctttgccactgtgggcccccccacatttattattattcctttccttttacgaaataaaaaataaaaaatcaaacaaacaaggcaaaaggtttcttaagtatttagtttcattatataaataaaataaatgcctagatctagtaaataatcacattatgtggtgtgggtcaggaataaagcttcacacacgaaaaaagaaatcttgcaagtaaacagctgaacacattaattgtttttaaagaaatctaaagttattgaagaaaacaactgagacatgataatttgactaattaatacttttagtgaaggagacgtattttaaaagataaagtataattataataataattaataaaataaataacgattaatatttagtaatttcattctatgtaatattagtatgatctcaactcaactgataattttcaagataatagttataattgcactctgtggaatcttaagttctttctccaaagaaaaaaaaaaacattttttcttccccttgtcgtgttctcttattctgccatctccaattctgttcacaatcgtaggttgtgccgccaatgatgtttaatgataaagatcaaatacgtttgcaatgaatcgggatgacaagactgagacaaccaataggtgaagctaaccaatgcacaagtgctccaatcaataaaacaggcccaaaaaggtggggtggtccaaaatgtgaaggtaagtttaagtagggtgttcacgccttggattgcgtctgtgtaaatccgtcacccaatccaaacaaaaaatattggatggatttgtgtgtttttctttttaaatcgacctaatctgatcatgaatgaatttgatcgagatggatttgttattaaaaaaagttcaaaaataattttcttaaattttttaaaatattttttagaatttacaatacaattacttgtaatatagttgcataaaaaaaattaaccaccaatttcaatgcacatattaactgcatcataaaatcaaattgaaaacaagtaaccaacaaacatttaatttataaagcaaataatactaaatcaaatttcaaccataaagcagataacaaattgtcttgaaaacttagtaatcttataaagtacacactagtacaaaataaacttaaaatcatcccaaaaaatatataatactacaatagaaacactgcaatatagtgataatgtcagacaattgctcaaccagccaacctcacacatagaaacacggtaagcaaaagatcaaaatcaattattatactaataataaatttaaattatgctatgcagaaaaaagaaatatgccaaaaaagaaatcatatcataaactaagttaaaaatattaccttaagaactaatagtcctaactcccaatactaatactcctaagaatagtccaagtagtaatcctaacactaacattatttaaagtcaaaccatacaactttaaaaaatgttttaaaaagttcatcataacataatatcaatttatattcatattgtaaacaaacggaaaaaaaaaaagaaactattattgaatacctagttccatcttttttgtttcatctaattcaactcgtaaatcaccgacattttgcttattagttttgagtcaattttgggtacaaatcaaagcttcaacagtaatgggacttaaagaactacaaaaatggatcaagcactcaaccttttgtactaaatgcagactcaaatgacacaatagacataagaatgaccaatatatctctagccatgaaagaaataacatgatatttggatgctttcattttccaccatgccaaaatgtcaaatccaagaccgtcatcttcattgtcatcctttaaatacatatccaactcactcctttgctattcaccacattttttattcattttcaatctaaattggtcgtcccaatcctcatcctcatcaacatcgttggcattaccttgtgaagcatggtatgaagccaaagtactagaattactactatcaatggaaataggatgttctgaagcatattcaacaaacatttttcttataagatcatccaattttttcagcatctctttggtttggtcaacaccatgcattttcttaaaacaaaactcaatataatcaaatttataacacagatcaagaaaagcagtcacaaataaaagatagctaatctgatcactctctcaatacttgttaaacttgagttgcatattagttgtctcttttgtatcaccggatcatcctcatgcctccatctatttaggcatttctgaatagtaaccaacttcttaaagaaattcttagctgtaacatgtagtgacccagaaaaaaaaattgcatcatagaaaactttcaaaaaactcacaaacacacgagcatgtttctaatccatctctttaggacatcctccttcactatttagaagagtgagcacatatgcagcctcaacatactcataacgattgaaagcttgttcaaattttcagcaacatctaacatcaaataagtggagtgacccagaaaaaaaaattgcatcatagaaaactttcaaaaaactcacaaacacacgagcacgtttctaatccatctctttaggacatcctccttcactatttagaagagtgagcacatatgcagcctcaacatactcataacgattgaaagcttgttcaaattttcagcaacatctaacatcaaataagtggagttccatctggttggcacattaagtgttagcattgcctttgaatttacactaacgtcctccgcacacctctttaaagtagtcaacctacttggagaaaacctcacaaacttacatgcaacctttattttactaattgaagagtcaatttccttaaacccatcacatacaatcaaattcaaaatgtgtgttgttaactcattggcaagtggactaaattgtcacaagtaataaaataaaataaaagtctgagtatcaagtccacaggagctttatttgtacttaaattaatgtaaacccaaattttcaaacaagagataaagaattgagagtgaaaagttaaagggctagtaaaaggcaagaagataagaaaataaacaataatttgaatgcaaaacatgacttcaaaatgcaattgtgttgaaacttagcatgccaaaactacttgtgctacaatgttaatattttttctctatctaatattatccccgtgtttactcgcatttactatgatattctatctttggaaccccgcatcaagagcctaatttatctattttttctcccaaattcctttgcaaagataaaatagtaaatcatattaagattaaagatgtatgaaataagctaaacaaacatcattctattcctagacatgatttcatttagatgttctttcccaattctctaggaaacaaccattttcaaatgcattatctcctaaacaatacatgagcatgggtgattaaaccacaatcaataataataaagcacataaaagaacaatagaactgaaattgcattaaataaatagtaaggaagagttacattacaagagtttggtctatcaggctctcaacaatgaggggtttagcctctaccatgagagactttacactttaagggttgatggaggtaaaagaagaaaagggatgaataaagaaagagaaggagagaatggttatagaaggagggtttcccctattagagatgttcaggctttgggtgtattcaagagagagttctaagtttcggtgtgtctttctccttttgcttaaggtagcttaaaattcacacgatctcacgctaagagcgcccttctgggcttagcaggtatggcggtgatcacgcactaagtgcgacggcatctgggcttagcgagtatggtagcaagcacgcacttagcgcgagattcacactaaacgcgcctttgggcttcttcatgaatcttcttcacgctaagcttgatctgactactaagtgagacgacgcgctaagcctttcttgtatgctaaacaagctgtctccatcttcaattttttttcaagactttttcttcacgtttttgcatcaattttttctccggcacttgtaatttccttcttttgaatcttgctgatcaagaatcaaaatgatattaaaatcctcattatttcattgaaaacaacagtaaagtagaggaattcttagtcaaaattgactatcaattaaacccaaatttcccagttatcatgtgctgaacgctgcatatgtataaactcttcattcaacaaagtatgatcatttcaaacactaagacctctacttaaatatgaaatggctacactgttagcacttgcattatcaactgttatacaacaaattttttgaatccctcattctttcaggcaattctctagggctatccaagtggtttcacctttgtggtcaccaatcaaacaaaattttagtattttcttatgcaacctaaatacttcatcaatgtaataagttgtcacacacatgtaattcacattttggattaatgtccatgtatcaattgtaagtgaaaccattgtttatttgcaaacaatatgcattccaactgcttttcattattaaacacttgaatgcaatatctagcaatagtcacatgagaagaaatattaaaataaggttgagccacttccataaacttcctaaacctttcatattcaacaaatttaaaagaaagttcatttgtaatgatcatctttgcaagttctataatagttctctcttgattgaaatcaacaaatttcacactaagagcattagggtcaccctcacatttctttccaacaataattgtttttttatttctcatcaacctgcctaaagggtttttcatacatgaagctaaatgtttgttcaagtttttggttccatatttagaactattagccttatagcattttttacaatacttgcaaaaggcatcattatttaccctatcaaaatgattccacacttcagaaggggatcaaatagagcttgcgacccttgttgtgtgggaacctccagcacttgttttgttttgattgtgatggagcaccagctgctacaggttcagtaggggacattgagagggagtaaacggtggcaaaggacttaagacattgacacttccaataaaacttctattttccatttgtcaaatttaataatttaacaaccgtcaactacaagtctacaacgtgtatcatataaaaaataatgaataataatataaatacaactatatattttttcttaagtgaataacatctacaaattacactcaaatgagtcacttaagcataattattaatacaactatatattttcttatgtggcaagaacattatactttgtttagagttgtacaaatacttacttagtagtagacaagtgactaggaattttattaccaagaacttattccacaaatccaaattccaaattcatgttctaacctctaacaactatatatatattccttgtcatttgatgagtatgctttgatttcctatggaatctcatctttgtctctaatttgtattcattgaaactcttgaattagaaaagccacatgtacctagtatcatttgatcataattcatatccttatgtgatccaaattttctttgctaataatgttatttaaaacatgtactatctctttatttctacatcaaccaagaatgtatttcttgatattcataccagatttttgtcacactgttccccacagtgatagttcctaaatataattttttatgagtcgaagacaaataaaaaaccacatttataacaagcaatacaaacaaagcagtcacaatatagcaatctatcatatgctgtaagagaatatcaggaaggtaatcataaaatgagataaaggctgaataatttgtaaaatatctccacctagagagtataagtacagattttaataaccacatcaaaagaataaaaaaaaaattatgtttcagacacattcaccacagtgatggtttcttaaaaaaaatcatctatcgattcatatgtaccaattattaatacaataatgcagttaaatatgcagtaagcattttgtctaccagtgccatgtagacgtaggagagtgacagagaggttgcggcagcatcgccggcgtagcgcagtcgcgcagagagattgagagaggatggagatgcgaagcgccaaagagaaaggcggagcagagacctgagaaaggacgcagtcacgcagtcgcacaaccgcgagggaggaagaggcggagcgagcgcaacggcgcggagggacggagatgcgaagcatcagagagcgaggtggagcggagaccttagcgctgcgacgacggtgaacaaagaggccgagtgcagtggcgcggaaggagggccggaccgtcggagggagacgcggagtcggagtagtcgagtagacatagtggggggcgatatcgcgataggatttatcctctgggaggaataattaattaattggtaatatattattttttttataatattaatttattatataaaggtttcatcggactcggtattatgtaacccgtcccgaatatgattaggttttataaggttggattaggtttgattcaataaaaaaaacttatccaaattaattgggttagattggatcattggattatttgtacataagtttaagaacataatcgatggaatttgacaattcatgaagggtatttaggcaatgtttgtctaggttttctttcttttttttattttgtaaaaaaaacattttgcttaatattttttccttaatgattagtaatataaaatataaaaaaatgttagcaacacactctttttaacacatatttttccattggttaaaaattattaaaaactacaaaaattagaagaaaaaattattaaataagaaatgagactcacaaaaatttataaattttaataaattttaactaataatagtgttattaacatttctggatatagagattaatgaggggttttctaatcttttctttattaaaaaaatatgatgtaaaggtctaaatttatagtcctcatgtaaatcacgtgtgtgtatttggaaaatattcaagtatctattagagctatctatataatacggtggagtggagttgagtcatatagcctctcacctacaatgactaggactctcgcaaatattggtgcgcaaactccttgcttctgtatttttagagaacgagaggtaatatatgatccatccatgagtatgcgaattgggaatgatgcatgattttgctcatatcaaagggggagaggggtgacgactaatatatcttatagttaaatagataaaatgttttgatttttgtgatatttttttaacaataatcgttgaatatcaaaaacttattattatttttttaggacgaggaaggtgctgtaaatgaaaaggaagtaataaattgaagtttatcaaaaccaatgctttcggcttctgaaatacgagatctacataaagacaattctaatgaatgttatgaagagtttgattggaaaatcaatggcaaaaggaagaaaatttattaactcgatgtaattaaaattggtgaaataataaaatctatattaaaaaaaaattacgcaatagctcttgaaacgaatccccaacaaacgatatgaatttcatgtagaaatttggtactttgatacagaaagaggcaaaatgaaatgattttgtcattttgagctttgatttattagtagaaaaccgttccaaattctgaattgccaaattttgggaaaatggtaatccagattgatcttttgtgtgagtgtggtgatcttgaatgttcattaagagctaatcattaatagtatttatttatcacacacaaaaaaatcttaaatatactcctataaatatttatatataaacaaggcactttaaattgacaacgtgcaaaaatcatacaggattcgtagcagacctaatcttcgtgtgcccctaggcatttaacctagggaaccaaggatcaagttacaaaagaatattattttaaaagaatttgtttgggactatatagaccaaagaacaaataactgtggctatgtacactagcaagataaataatacaaaatttagacaaaaatttcttttcaaccatgtatcctgttttccaatttcaaagctgtcactaaagacagaaacgggtatcacttgttagaccactgaaattctatttctaaattcctcgagggtccacttttactttccggcaacagagtgtactctccagatactgcacctagcattactacccgatcaatctggattgtcactttcccaaatgaactctgtggtcagataaaaaaaaaatagatgggttaagcggaagcctaaaaccaaaataactgaagatggatagactgcatttacaagtccaatttttccacaattacctttcccattttgctcttgtttttgcaagaaatgtgaagcttttggccttttggaggactctcaaaggaccatgtaaagctctcatcccactccggattagggccagttgagaccacctgatcagcacattctcatggtaattagcacattcactttccgagtaggaaatcacatcaaaatagaaagaaaacatgattttccacgaattgtatattgtgataaccacagattcagaatgcaaatcattgtcccttgcgtttaaaacaatagaaaagaaattgaagtgggtgtggctcttggcaagtgagaaccatatacttccgtatcaatattgtaacaaatcgcatttaagtcaaaagctacttcaaaaggaaagaaaaaaacaatttgggtgaatctggattctaaagtctggcaacagaactgcaatggaatatgtaatagtcaactggatttttttttctaggaagtagctataaaggtctatatcctaattgggcattttctaatattggcataatttcgataaggacatagcagataacattatttattatgcaaaagattgacatggagatacagtcatatattagtctcacataaaacaagcacgtcatccatttcaactaatcctagtgcactagtggagaagaagatcacaaagcaagataataaatacaaaattatttttaaaataccttggtttgccttggaggagtgtttccgagtgtaagcttgcaaaaaacacttgggtttccaacagattgcttcatgttgttaccgcgcttgatgatcaccaccaatgttcctggcaaacactgcaataaaaattctgccttctcctgaaagcgaggtgggccagactggattaagtactgcagcaaaggtatagcatctgcagctgctattgactgagctcttgaaacttctgctggacatgctgaccaagcttgcctaagcaggaaaagtgcattcaaggcagcttcctgagtagcctcagagcctgtctttaaggacgtaaccaaatggggaatgctaagtgttgctggttcagttgctctcagtcttgggaagttgctaaatagagaatttaaggctttaagatactcatcattcacagatccagtagcccataagtccttttcaatagcagctaaaagaacagacacaaaaaatgttaggcatatttacatactgatgagagaggttatcaaggtgaagcaacttattgtcagacagacagaatcaacattgctcaccaatgaattcagattagaaatagcacctttatctacagacaagactttcaaattcaacctatactttctctgatacattaatgaatatttacagaagactaggcgcctattttagctagaagaggttatatagaacaactaagagtcaagctgttcaacttatgaagcaattaagtgcactacaagttttactattcatttgttccttccccaaatttttggtttcattaccaataatcaaccaaaaagaatcagctctgctatttttccaaaagatgtattaaaagtcacatgtagcatttttgttttttttttttattgaaaatcaagttatgcttctgcttataatagcaaagaaaaatgctttactatgtctatgactatgagaatcaattatttgattcaagaacaagaaaacaacatcagaaattatcatgtgaaaagtaacaaatacaccattctatatgatgaaaagcgaagataagatataccgtagtggttcagagtaaaaataacaagtatttaacactgcacgataggaaaataactcaccagttattgctctgactgtttcactagaagcatactcttgaatggtatgatttgaaaatagaagtttaataaacattgcagcctgaacagatgtttcaggatcacttgaacctatcagatccagtataacctgaaccccacccgcctctgcaactgctcttttatttgatcgactgtacatcacaaggttttgcagagcacatatggctacaactttcatttcttcagttggttggtcttcaagcacattcactaaagcacgacaagctgaaactgcatcacttgtccgagcaagaccctcattctgaaatagatcaccaagagccaaagttgctaatagccttgcttgttgtgcttgggtttgtgggtccaagagataatgggataatggtaagatggctgacttggtaacttttgtttctctgatctttacattgttaagcaaaacttctaagagtcttgcagcagtttcctcgcactgatgagatcttaggagctccaatagagcctctatagcaccactttcagccattgcttcagcgctagttccgtcatcactttccaacacaagaagagcatttaatgcaccaacaactgtgctttctaagccagaccgaagcagcctaaccaaaacagcaactggaacttccaagtagtattcagaactaaattgtagaatactagccaaaacagaggcagcagactcccataaagcatgaggaatggaaggatcagattgcaatataacttttgaaatttcaataacaccaccttcttttgcaatttcatttggccatatcaatgcaatactgaccagggcctttacagctctttgctgcaatatatgtataccagaaccaagaactcgtataagagggccaattacctgttgcgtcaccggatctttctgaaggtgttcttctaaaagtagatgcgagagaagctcagcagccaactgttgcactgctgatattggagaatcaagcaaagggataagaggttcaataacttggtgacaagtcaatgtgtaatcagcacgacactgcggatgttctaagatattaactaaaacctgcaatgcactatgttgtccatctggcccaaattcttctcttgtcagcaacataaacaggggttcaactactttagcagccgatggtcctttagctatgctagcattattggtcaatatacgcaacaattctgcaaaagctgcacatagataatcaggtgcttcatgaaggatgtcaagtatgctttcaataactccagctttcaccatttccattttacaagctggcctgtcttttcctaacttgaccagagctctggaaatggcctcatgaagtacatgattcctaccataaagtaggccaacaagaggaataactgcaccatgtgcagcaactaattcagccagttgctcatcatcaacaagcctatccaatgcacggacaactgaatggtgagcaggactaaactcacttacaaggagagagaccagaggttcaacacaatgtgcagcagccattgtagaccgaatccttgtatttccaaaaagaacagaacataattcagcagcatcccctttgaggtccattgagcaatctgatgagagaatcctgcaaagaacatccactgcattcatctcaacatctgcaacagcaagtgcttttgaagggttttcactcagtaacctaaccaatgcagcaattgcagcatgctgctctctctctaaaccagtattaagaatctccaccaagggttgaacagcttgtcgagcagtctctgcatttctaatatggtcagcagagaataaactttccaaagcttttgcagccctataccttgcagctcttcctcctaaacgcaagacagctacaagttgagtaacagctccaaatgctgactcatgtctccgaatttctgcactgctaaacagaattcctaacaaatctgtagcagcttcttccgttgcatcttgcggacctagtgaaagatacttggaaagtgcctctagggcccctgcctcaaccattaaaatcttatttgatggacaatctatagaaagctgagtcaaaagcccaagtgctaaaaatggtgctcctgggcgttctggaattggtttgagcagatcaactagagcaggtattgccttccgagaagtggcaccaactcttatgtcatcaactctaaacaacctctcaagagcaacttgatcaggataatgcaccaaagaaaattcatctgacaattccagaagatcctgtatatcagaatcagcacagccaagcaaggagataagtccacctgctgccccagaatttgccacagacagaagtgttcccctgctaccattacagactaggctagctattgattgtgcagcaaaatatctgttcgctgattcctctgacttcaataagttggcaagggctggtatagatttcatggttgcatgcgctcgtatgatatccctatcttgaaataatactgccaacaacaaagcacaaatccacatactgctatcttctttataatcaatctgcatatcatatcaccataaaggagcaaagatttacacacagaaataatagttatatactaatctgctatctaactactatgtcaatgaggaggggtgtatttgtaaacaactttgaaagatatggatgcgtctatgcaaataagtaaatatttactatggaaagaatcagataccactgtctatttcaaattgactgaaaacatgcactagaatacctgactatattgtgagaaacaatctgcaatcctgtcagtgagaacctcaattgctccagcctccattattgcaattttacttttttcatcatggcaagcaagaacagacagtaaccatatagctaagttggcactggaaataagagcggtgccagtgcttgatttacaatcattggcttcttttgtatgcctgcaaatgctgataacttccctgctgtcatcaccctgattatccaatgtagcctgtgaaaaaataagcatatcgaccagagactgaacaagattagcacacaagtttgataaattgaggtcctccaccagcttctgatgatttactttagcagcacaaataagaacagcagctcctccaattttgacctttacatttttagaagtggaattgattatccttttagctatagaagatatacatccagaggcagtaacaacagtgtctcccagaacaaaaggctgatccttacataatcgagataatatttcaatagctttatcctgcaacactggcgttgaatcagcaatagacaaaactattgggattatgcttttaggaaattcagctaaaactgcccaagcaggtttactgtgtgcactggtcaaatctgacctggaaagcatggcaagtgcttcaagagcttctgatgtggaactatgttcatcaatagcaaagtctaagaaagaaactaatgcaagaacagtgccagctcgattcacacaatcagttacagaataatcaacttgcctcttagaatgtaagaggcgagcaattgctgcagcagcatgtgtttttccagaaattgtgccttcacgtaatactctggtagcagccaagatgacttcttctgcaacagctttctcagcaatttcactatccaaaataagatttgccacagcacatgttgccagctctgccacttctaaaactgaagagttagctagtgcagctagggagggtaatgcatctctagcaatagcagccatatccttgttctctttgatggaaagaaatatagcagccaagcagcgcgaggactccattaagatactttcagattcaacattaagcaacttcattgctgaccaaagagttttaacagcaatgctgctttcacgcacatctttcctcgtttcaaaaattcccgccagagcagatgcagactttgcctgagtttcttccttggttgagctcaatagttttatcattgtaacaattgcatcactagcagcactaccttcacgtagaagatcagtaagagcaacaactgaaagcatacttctcaaagcatctaaaacataaaccttagattcaggtaaatcactagtcaataatgctgtaagctgactgatagttgctgtatcagatttatgaattaagtgattcaaagtctttgctgcaatctccttcccatttgggcttccattcttcaacagccacagcaatgcaggaacgacttcagcactttcaacacaagcacgtatatcctcactgtgatcgcataggttcctaaggattgttgctgagtcttcctttgcttttgcagatcctgactccaaaatttgaacaagaggaggtataccaccagcagcagtaatggcccatttactttcatcattttcattagataaaaggcaaaggagggcaacagcacattcttgctgctgttctgatgaaagccccagaagagatatcaacagctgaactccttcacggccttgaagtgcacgccatagactgcattcagtattgcacaatgtcaagagagactttagaagctcctcttgcacttcattggcagccatcgttattaaaccaacaagcaaacgctttgcatcagagtttgtaagtttaattgacaatataggattgctatacaaactagctagggcttcaatggtccgttcctgcacaaggaatggcaagtgaggtttaaattgttcaagtaatgtctgctcaactaccaaaggatctgatgcccaggtagattctgccttgtcatcatatatcataagagctgaagctaaagcccccaatgtgtcagcagcttgagtaggagaggagcatgattcaaggctttgaccaagactggagatgacatacgacaacccaccagagatgtttgctaaagcacacatagcattttcctgtaacgcttgagcatactcaccctgcatgaactctttggaaggagctatggtagcattaatcaaagcaggaatgccattggaattggctatctctttccttgcatctttgcactgggcagatagagatttaagagcaccagctgcctcagccctgacaggggcatcattaccagggcctaaaagtttgaggagttgttttgttgtctctgctgtcaacaactttgaacaaacagatgcatcctccatcatcatacaagcaagtaaaaagcacacattggctaaagtgctagactgcccagttgtcagtaacttaattaatatgtccactcctccagcttgtattgtggcattccagaatctctcagtgctgctggagagatttttcaatgccccagtcaataaattatcaactacatttccagtcttcaggcccttttgcagctgctcccatagcactggaacaactccttcagttgaaaaaatttttgatccaacatgatctttggcaccaccttgagagacagcaaaaatagtctttgcagcagctacttgaccttcagcagaactggactttagtagaccaagcaaaggaggaatgcaacctccaagcaagactttcaccctcagctcattttctttacaaagtgagcccaagacagttgctgcctgtattttcacattcaatgaccctgaccggagaagggaaacaagtactggaactgcctgagaatgagatccaacagcactgaaagcattttctctcatatctataagctccaataactgcttcaaagaatactctttctcttgcatagaagatgagctctgacgcagctgctcaatgcattgggcaacacttgctaatgtcccatctggatcctccatgctgctgctgttgctacgttctctgcaaacaattaggaacgtaagatacaaaagtttgcacattagattttatgctcaaactcaaatttccatagaccatatatcaattatcaaaccatcaagttagatagttctcattatcttctatgtatgagactatctgagggggtgagaggggaacattttttttctgccttagaacttttgacatggataacacaataagagggattcagaagtcttagcttagctgcaaacagaagtactaatgtaacagcatggattttagctgagcattataagcaattgatttggtgattttttaagccataaaatattctttttggacataattaaaaggcatatcctaagctgtaaccaacctcaatcccatcttcagaactgaatgaggaggtagaggctctgaatcttgagccttcccatcaccatttctttcctgcaatcaaaagaatcacagtgagcaagtttaaacggaatgtctgtacatctgtaaatgatgaaagtaacaaaagttaacataaacatagaaacaatatattagattcggtacaatatggataaagatcaaccttgaagttctataagaggagaaatggaaaatgaagttgaaaaggaaaatagccaaaccatatatcaaaccttgacttcattttgtatcaagtaattgaagattttcaaagtattaaacacacatgattgttgcttccgttacagttgactaattatcattaaggatagcatcttattgcacaaaacagaggggagatataaaatgaaataaaaactatacagcattaagtaatgcaacaaagcatttgtacattacactagtgtagaacaattaccataactaacccattaagatagatggtcatgaatgctatatttttaagagaatctaataatgccaccttttatttttcattttctagcattaccctgtactcaatcctagtgccaaggatatgtataagcatataccaaatgatggtagagtgcatgactaaaataatgcttgctacctaaaatagaatatttctcatcaacttcataatatttataaaaccatgagcatctcaattcaaagaatggcaacagatatgttccaatgggatataagaaacagataacgaaatgaaatcacagagcctctttagatttccatggttctcatcggtactttctagaattatttgatacaaaaaaaaaaaaaaagtgtttaatacaaatcaagggttgttgggctagttttagaagtctccacaaccacaactgccgttgcatctcccttccactgtctgcaatttctaaaatcacagcataacctcgaccgaaatttaaaaacataaatgaccagcaagcaatctgaagcgataatatatccaatgtgtacaggccgagttaaggattcataacagtcaaaactaattgtttatactaattctcaaacacttttcctccaccagtaatgatgatgtgatgacataaaatgaataaataaaaaaggagaaataatggaaaaacatgaagaagtaccatatcattagcagcaagggtgctgccattattggcagcaaacctccaagtcagtgtagtcgccagcttcgctccgcgtcactcgaattctcctccaagcagatcaatccaggacactgctccctctccagatctacactggagagttcgtcagcacatcaaagcctccctgtccacaccacacggtaattcagatcagaaaccaaacagcaattgcacagaaatcgcaaatgcaagttcaacaagttaaaaactacacagtgacctaaccaaaacactgtaaaaaaaaaaatcaagctaacaatggaatcggttaaaattgaatcgcgcgagagacagtcagagagattggaggtagcagatcaacagctactaccgaggaatgggagtggaaagcgtgcagcggggtcaacgaaaaagtcaaagcggttacgacggaatgcaggaatcgaatgaatgctagtgaaaattgaagaattgaaaaaaaaaacgaagaggtgagagagaccttgagggagtgagaagcgaagcaggtttgttggtgtgagaatgacgcatggattggtttagcggtggcggtggtggtagtgggagacagatttgattattgattattagaggtgaggcttcgttaagaaaagagtgcgttatgtgatttttcggttttgaattgacggagaagggagtgtttgtgacaatgagcaccgacaacagctccagcctgcaagctcatagcctcgccgcgtcatttaacggctaggctcagccttcaggttcgcttgagccacccgtttggaatagaatcacgtggaaataaaataatgtacctctttttacatttttatatcatttctcgcatggacaaatttgtatctcatcatttttcttttttaaatttttttctcatcagtacacttatcatttttattattattttctcttctaattccaccccaatctatttcatttcagagtagataataatcaatacttataatcttttgtatgcatatttttattagttttaatacgtgtgcagacatgtacaaaattgattaataagtattataaatattatattaatatcgctgattaatatttactaacataaatattataagtattataggtatgcgttatattcatattcatatttgtattttattatatatatatatatatatatatatatatatatatgtatacatattatagtaaacccacctcatactaatgataggacacaaatcattttttgtgttttatgtatttttttaatattaattaatttctattaaactttaatgtaaaaattaaaaaaaaatgacttttttacaatttttaagatttttgataccatgtgaaaatcactattaatttacatgtttcataaattgtaagtttgttgaaaatcactctcttaaaattttcagtgattgaattttctctttgaagattttttttcttctcttaaattataaattagatggttgaggttattaattttggaatacacgtaattgtcctttggaattaccgaatgtcatttttgtattcatgtttttcaatctcaaatacaaataaatagttgcttatatttttagtattttaaattttaaatttgcgtaaagaaaaatagattctttgaaatgatggttctttgaaagtatatatattttttatatggcttgcataacattgcgaattttaacttgtgaagaaattaatgtatacaataaataatgtttgcctaagaatattttttattaaatacgttaaccaactacttcaattaaagttttaatgttccaactaagttcgtatatattaacgatacgaagaactcgagaattttattgaccatttttttttttgctgagattattgaccatatgtttatgaaataaaaaatgataccagtgcaaacattattttcaccaatttcttacagaaaaacgtggtatatatatactggccattggaaaatagatgactaactgtttatacagagtttgttagtattaagttttgtcaaaataaagttaatgcaaatattatttctttatttacagtagtttttgacatatacaatattattatatatttttttaggaaagaatattattatacttaagtactaactattattttctggcaaatatattaactagtgttatttatttgtgagtacactcgattttaatagaaacattaattattaattaccttttctttgtacagagttaattaacatttgatatatacttatatgagattttaatttgaatttaatatattttatattcagatattttattttaatttaaaaattgagattagacattcacatttacaaaagataatcattttcataatagtttttttaatatatatatatatatatatatatatatatatatattattaagaaaatttaaatcttatgcatcaattacatatcagccctgctcttcccactaataaaaagcatatatgcattcgttattggaagtaattaaagatttttgtgatttattttttccaaatttgagaattttagatttcttttaataattttttttaggttaaattaatttttccctttatttatttagttagatcaattcaatccttttaattttttaaattggtgtaatattgtcgtttttatccgatttagttaaaatcaatagctttgtaatttagtcccttagttttgaaagcattgtaatttacatgacaacaataatttagtaaataaattatttatccaactcgaataaaattatcttaaataatatatattagaaaaaaatgttgatttactattataatatttttcacttgtatttacatttttttttactagtaaactgtttacttaaaagtgattttatcaccatttacagataataatattttttactgaaaaaactttactttaatctcatttttaattaaagacaaatttataaaattaaaatgatttgaaatcatatatacaaaatattgatctgatccaaactcaattgattttttcataaaaaaacacattatatattgttttgacccaataattaacaagaaccaaactccaataattcgacttaaaaaaaaaacttcaattattcgttgcatatgaccacatggttttcattttagctgagcttgagctcttgattgtggccaagccatagcctacatccaaaaaaatggaaagtcatctcaattatatcccatttttttgtgcttagttggcaaaggtatattttctctctcactctattgcacagtggagcgtttgatggcaatggaatcctttgatttttcaaaggtagtaataaaggcatataagaaaatagtcttttattataagctgtgagaggtgggtgcagaagttaaagacaagctaccaagcattcatgttattactagcatatattatatgcaccagctggcaagtcatgaggctagattattatgcaataaaatcaatgtgggtcatgttattcgcacttgcaccctgtaagcatttgctgttatcatgcaatcatagggaccctgtacagtaccagctagctaaaccacccattacttgttttattattctagtcttaaattaaactaacagcaattaggttgcatattaatgttaatttccttcgatcgatttgtctaatcccctatactgtcttgccccttgttcatttgcacacatccttattttttttttttttcttaagcagatccagatgaccaagtggcttttgttatttcatcccatttctcaaaatactgattcaaagtcgagtttggctctcctcgttttttaggctctgtttgtttgcgaccacattggtaatttggtgcatatgaaattgagttgggcttgtttggtataactaatgcatgtgagaaataatttacgaccaacctaagcggtcaataattatcattataacactaaattattgataaacattgtattgggctttcatttaagagtgaatatgtgatgaattgggtcattcattgtgtagctcgttgaaaaaatccttacttgctactagtgagttaaaagactaacatcatttttattttcagtttcatacccatgtaaaagctctctagaaaatgggcaatttactctcaatacaataattgagttctctcatgagttgaagagccatgaacctaataataaatctaggtattcaggtacacgtttattatcccctctttgtcgtaattaatatattgtaatttgtacccttgtgtgatttggacattctacacacttgctttaaaattcatcaattggtatcaaaacaacttagatacaaattatggctattgtttttcattgttctttcatcaaaacattgtcaaaacgtgggtttttttggcttattggttatttttctaagattattaaaaaacttgttaatttttcatacattaaatctataattgtttgagggtttttggtttatttgcttattggtttgtgttccttatcatgctcgcgacaacatattaaaagtgtgatttagtaaactaattataaagaatttgatggttggttttgcaaatatccttccacgaaccctaaacatttcaaaccaaattactcacagatatagtttttttcaaaaattgattgagagatcgtgtagaaaaagtaaatttcaagcaaaactcatcctcaatatcctttttgtattggtttataaacatgagagaattgggaaaacgcttttgttttttgatccattctcacatctgcgattttgcttctttttctttctttcttccatgtatgtgtttccaacctttcttctgaaattgattggggattctctatattgatagttttcaaacaaaatttctcaagttttactatgtatagggacattttatcaaatccataacccataaaattttattttgttgtcatttttgtgaaaaatatgtactaaatagtttatctgattacatgtcttagtgagtgtctgatttcgattaaaaaacatatgtatttgatatttttcacaacaatttcagactaaagacacaaaagcctaatatacttagtttagtgtgatgcgcatcaccttaggtgctcatacatccaaacacttacacacttgttttagtaaataatgttatattctatctcaaataaatccaatgtttagaataaatccttgattgacttattattattaatatgctcatttataaattattgtcaaagataattttgttgaacaaattttttaaatatttacaaaatatacgtttcttgcgttgtatatgaatcatattgatttatagttggagtttttagttgatatcacattacatacttttagtgtgtgattggatagctccaaaatcatggttgatcatgatgaggtaagtcaatcttaatttttatcaaatttacatgtttagattatttttaaaattatggtagaatcaattatgatggaaaaaaaaatcatggtagaattgaaacaaataggagtaatttcaacttctatcaaaatcagttatgtaaaatcatcatcaatctaaacacacacttatcatgttatcaaagctaactgatacaaaaaaattataaggtgattttaaattctatggcccgcactaatttttataggattttgctaactaatatccttaaaacattagttaaaaaactaaaagaaaaaaaatacttatgatggagattataagaaagcataaaaaagtcataaatgataattttgtacatctcaataatttttaattctttaatcttttaaataatattctaagaacactagttaacatttgatatttttatagatatattaagtgttattaatattttacatgtggtatgcttaggcctagtaagcccttcaagatattatgcatattaaggactttcttttcaaaagaaaagtaataattatatctataaaaatatcaaatgttaactccgaaaatatcaaatgcttaggcctagtaagcccttcaagatattattcaatccgatgtttgtcctctctgtatggtaactaggggtgggaataggccagaccgacctacatggacctacgacctgccctacataaagtctggtctgaactgacccatttaattaagaggttaggttcaagcttttttaaaaagcttattaaattaaatagatcagacttaggcttgttaaaaagccttataagtctgataggtcggcctatatatatatatatatatatgtatatgtatatatatatatatatgtatatatatttatattatttgttgataccaatttatacttatattattttttgggtacaattaatttttttttgaaaccagcagactttgattatacattactgctccataacttccattcctataatcaagtaagactttaattaccatttaggtgtgaattatgtacccctttatattacccatgatttttattggcttttttgttaacgtttccttttccattaactttcctattacgttcctacgtcaaagcaaacaaatataaaaaggctatcaggccaggctaggtttttaaaaaggtcaggccgagccaaaataaaagcttttgataggctataggccagattcaggcctcaaaaattaatcgtaggctaggctcaggttttttaaagtttggtctagcctggcctattcccacccctaatggcaactcattgagagcgtaattgggccaagccacgcggattgttattgtgagtggcaatttgggggcaattgcttcctacacctctaaattacttaatgcaatcccataattttaaatatatccaaattgaccttattataacttcatttctaccttctttctcatttctccttcgttgacgcattattgaggtgtgcagaaggagtggttcgtatacattttaggcaaagggagtgtgaagtgggtattttaactatttttttccaatttgcatatattttccaaatagctgaattcctaagatacaaaaagaaaaaaaaccacttccaaaaaaacatttccaaaatcatgttaacattattcctaaattgaatttttggaatgcattttttctggaaaaggtaaccatgaattatgttagcataatttcataaatgcttttttggaagtgttttttttttgtttttttgtatctaacaagctcaactatctgaaaggtattagagatttttttggattacatattttggagaatgcttaaaatcaacaaccataccagtcaattcaccaacaacatgccattgctatcttcgtcaggtgcaaaaagaaaataaagaagaaaggggttgaggaaggtctcggctcccaaaggaaaaggaatgaggtataagagacactcaagggcattttgaaccattcaaattgttttaaaattcctatgggatgcaggaagcaaattaaggggtctaggaagtaattgtccaatttggttttccaacaaaatcatgcttatggtgaatccactcaataaatagatgcactagctaaattttgtttgtctcaatgtgttccttttcatctctttcattttgtttctcatttttcatccttaccatatgtttgctaaagtgtctctttttctagaaacttttagtttgggctaaggccctgtcatgaataaaaatagaatgctcttggggtgttgctagtggtcccaacctctctatggaaaagtatattttgcccctccttcttcctacttccttttctcctaccatctcatccactccccccccacctattatcacctaatcccgaccagatctagaatccctatcccatttcctccatgccgcacaccactaccagccttaccatcactattgcacaaaagtccctactcgtgtatgatctccacttttgaggctccatgggcgcaactcctccccatcataactatgccgccatgaacattcacagttgtgcactcctttgtcataatggaatcacatttttgcatggatatttggctgcataaaatcgtgatttcgttggattaagtgggggtgttgcaaaatataacaatgaaatcatgatttgttgttatatttagcgtggaaatttttttacgataaaattgtgattctattgtgttaggggggttgaaaactaataaagaaaagaatcacaatttcattatacattttattcaataaaatcacaatttcatataaaggatattcttggaataaaaaaacttcagccccttgataggagtcaagaagcaattttaatagggcaatagtaacttccctcctgtgttgggtattagaacttttatatgtcggcccaaataagaaacagaagcccagctcaggcacggggagatgaaattctcgattatctttcagccacgtgttaggggcattatcggaatcacaacgagaaaatcttaatgttagcaaccgctgtggaaccgagacccacttggtattacttcagggttccctcacggaacggaacaaaaggcgcacacaatcgccaaagagaaaaagaaccctcaaccaaacaacaacaacaacaaaaaaaaagccctagaaaagattttggagaagcaatttctcactcctgaaaatctcatcctcttcttctttacatttgttttggataaaacattttgctgatactgaattttattttctcttgttttcgtttcttttcgacctttttttttttctgcttcgttgttttcagggagaaagggataggagtaataaaagagagtgcattcggtttggttcttcgcctcgggactcgaatcttcgatgcctctctgttttttcttctctggcgcctctttttctattctcaaattagggtttccgtgagcgttcctttttctcgattctccgcaaactattatcattgtgagtaattctccgttctctttctttcgcttagtaattcatatatgaatgtatttttatatataagttattttttgtttgaaatttcatggtttccttagatcttgccgttatcaatttgatgtccagttctctttctgcaccaaattctttcagtgtggtttaaattttaataaatagtttgtatgtgttagtatttttttttcatccgcacccagttcagtgtacagtgattttaggatgaacactgtgattgttggaattgattgttgtttgtttcttggtttttgtgaatttgattgttggcttcaggttagggaaggtgatttgcgtttggacataatgtcgtcaaaatatcagattcttgacaaccgccctattaatcagtggaaggttacagagctaaaagatgagctgaagaggaggaagttaagtatcaagggtttgaaggatgatttggtcaagcgtttggatgaagtccttcgtcttgaaagggaggctgacgaggcttctgagaaggatgaggccaatggtttcgatggtcatgtagatggggaaaaagattcagaggcggttactgtggatgctgaaatggttgattcaactgacagggacaatgccaaaacatttgagactgctgaaaagggcaagagcggtgtagttgatcctgttgaaatagaaaatgtggaaaagattccggaggttgtggatcacgacagcaataagaatgacaagcaggatggtgttaccaaccaagttgacattaataatagtgtgtcagccatagatcaagaggttgaacctaagggcttgccagctggtggagattctgcaaatgtgggacaggaggcaattgcccatggttctactgtggagaagactaccattacagttaatgagagtgtagtaacagaagtagtggccagtgctgaggattcttatcgtgcagaaaagaataatgaggattcagcagcaaagctggagaatgaggagtcaaaggcgcagctggatggtgaggactcaaagccccagctggattgtgacatcaagcccttgcatgaggatcctgtgcccgactcttctgttccagaaaaccaggtatctgaggtcaaccctagtttagggtctcaagtaaaatctgattctatttctactgattctctgtcaattaatcaaaagaatgaactaaaggatactataattactgataatgtcaaattagaacaagatattgttaagccagagatggtggaagaaccatcatccagaaatgatgtacctgtttcttatgatgaatcacattcaatggatgttggagggctgcatgagaaaaaggcatctgttgaagaaaatttcaataatgttttaagtccagacatgaacaagaccaatagcagcgatgatgtggggtatcccgaagagttgaacttggacagaagttctggtgatgattctatggaagaggatttgcctgagactaagcaaattgattctaagtttaatgttgatgaacttaaagacaaaatagagattgaagagcctattgtgaaggaggaaagtagtactatagctgttggagatggtctgtctgcaggagaaagtgatatccaccaagatattgacattagtccagttgctccaacagagaaacgaaaatttaatggtaagcaatatattgtctgaaattgacacttttttttttattggttgtactcctgaagggcaagaaagaattataggcactatatgttgctttactggcatgctgttattatttcttctttgtattttttaccatccagtattgtttggaacattttgtcacagaacaagcatcagttgggaacaatgagcctgcaaaaaggcaacgcaggtggaacactgaaacagttaaaggtccagatgcacaaagcactactcccaggcctgctactacacctagagatgagccaattgctttgaaacgcaacttctctaggtctgattcctctgcaactgatgatacacctaaagaacgcattggtaagtcaacattgttgtgattagggtaaatctattaagaactaatgctcctgtttgttgtgtaatggtggtgttaatggagatcaaatttcaattcctagctttgtggctcaaataaataaattcctggcaccttcagattttaatcctggacacttcttgaagcacaagttgcatatatcttatcctctaaaatgtatttgtggaggtttttattttaagatggacaactacctgctggttgattttttcatgcacttgtgcatttactgagataagacttagttgttgacttgttggttgtcatgcgcttttttacatgggtgtattttgtctatgttgtacagcatgtttttttatggattactttgttgtcatagtggcatgtgttgtattgtctgtctctgtttttcaagttaaatagtctttttttaatctttggcagttccaccaccacaaaggtccccaactaattccctcaggattgatcgttttctccgtccatttaccctaaaagcagtgcaagaacttcttggtaagactgggaatgtcagcagcttctggatggaccaaataaagacccattgctatgtgactgtaagataactcttattgctgtcttccttcaactgtaaattttcatgtgatgttgttatattatgacacggttctgacatctaagtaatcttttgttgatttcttggtgaatcagtactcgtctgtggatgaagccattgagacacggaatgctgtatataatttgcaatggccaccaaatggtgggcgtctcttagttgctgagtatgttgatcctgaagaagtgaaaatgaagttagaacctcctcctactcaggctgcatctgtcagcactgtcccagcagttcctcctgcacctccctcacagccagagccttcccctcgtctgcacagggagccgcatccagttccagctactctcccacctccaccaccattgtcaaaacccccaccagtagcaagagaacggcttccatctccaccaccccttcctgagaaagttgacccacccattgtcactctggatgatctctttcgcaaaaccacagccactcctcggatctactatctacctttgtctgaagagcaagttgcctcaaaacttacagcacagggtaaaagcgcgaggcagtagataggccattagcctgcaaatcttcttcccttgcagcctttactgatttggatattttaattagtggtatgggattattttgaatgtcttggcagatctggtggtgttttgtctcgggaagaaattgcattgcttgagacttaaatttatttagttttagaagtcgtgaactaagagctaccggggttggatagattttccccactgtttgaactaggcttgagcgaacctttacctaaaattttatggaaaaatttgacgttagaatatgtttatattcctagccacgaattttgttttcggtagctggctttttcttgatccgtgtattttcttatgctgagtgtcgattgattttagtctgttgattgagcatagtagatttcttctagccacgtggtttgtttgacatcaagtctagcaccgtaggaaggttgatttgtatgggttgactcgccaatttatccaccgtttgggagaatgtatcgcaagtttgttgttattttgggtacagtatggcatggatgtttattgtgatttggttttgatatgacttatataagtttttcatccataaaaaatatggtgttttcaaattactacttaatcacgtcactgaaatgtgactaatggtataacttgaaacaaaaaattttgaggtaattatttgataaaaaatttttttttagataataatttaaaaataatttatttttgaggtatgaaaaatttatttaaaccttttgattttggttgttattgtgaaaatctaactaaattgcatattaaatttatattaattttcttttacattcttatttaaattatcttttctataacttaagctggaactcattttttataatgatagtatgtggttttttttgtattgaaatcttagttatattgcattatttatatataatattgatactgcataattagttaactaatgatttgtaatgtatttttttatgaagtttataataatttaattgttgtcaaaaaccacttaagctgaatgaaaactaaacggtgaaaactaaaaaaaaaaagaacaacacggtgaacatccctactactaaggacgttgtatttgtttgttgagagttgtgggcctgtggctccctaggtaaatcagtaaagaaagactaactattcatttccctccttaaaagtgttaaaagtccttcaaagatagaaaattaatttttagtctctcaatgtttaaaaagtgtaataaaatcattctataactttttctgttaactatcacgattttacctaacacttttcgattaaattgtgataaagaatgtacatatgtgttgtttggttagcaaaatgagtaagagacttatttgtcagccaaaagtggatggattattttgtctctctcggagatttcttctattttttctccccccatttctttatcgttacaatcccagcttcccttccaatttgttttcacgcagttcatctttttcacctggatgctagcaaatagatctggttgacccgtgaactgaaccgcacgctgcaaccatttttggcgaccaaatggagtgggaagggatgcattttaatcatcttgtgaaggggggaaaacccataaccaattttgcaaaaggtttgataaaaaaaggaaaaaaaaaaacacaaagaacaaacatcatttgcacaacaatacgctggatcacttttttttggcaaattctttcatttttgaacaaataatcaagttctaatatatgacttgctaagaattggtttatctacaaaagcccttgattgatttaaaaaaatcattgagcaatgagcgagaaatttgaagaaaatgaaagaggaacacgtttggtttgagcaacaatttcataaatgagtgttttttgcaattactcaagtttaagtatgggttttgcttgaaattgattgaactacaagaacactcaatcaattttacaaaaaagaattcaatggagcaaaatcaagcgcaaaaagggaaaaaaaaatcccttttaaccttatatgttaggagtatgcttttgggatccaatttttaacctgtttcaaccttaattgcaataagcccattggtgagagaagaagatatagggaagaggagaaaagagatgatgggagggaagttgggatagcaacagtaaaaaaatgggaaaagaaaaaaatacaagaaatcttcaagggtaacaaaatagttcaacttttgggtgataaaaagttcatcctactcattcccccgactaagcaacacacatgtacattcctatttggtcaaaagatgtcgtgtatacaaaattgtgagagttaaaagtaaaatcattttgtcacactttttcaatattaagggactaaaaaataatttttcatctttcaataattgaaatgtcagaatttgacactttcaaagactgaaatgagtatttatgataaaaaaaaactaatgtcacccatttagaatacaaatttgagcatgaacatgaatattcttaataaaatattgttgcaaagtgtgtagattgaatttgagaacatcacaggtttacaccacaagaaaggatcagggaatttttaggaaaaaattcttgagtaaccaaaaaatgaaaaaccaataggtgtagggatagtttgggttccaacaatagagtgtcaaaacctgatagttgctcaagtcaatgaatctttaaagcatctccaataacttttcttacaatctaatctttcatgcaagatctgatcttgttaagatttattactagagtaaaaggattgatttccaccgtggagatctgttcttctacaagaataagcaagatctgcatgtgttttcaaaaaatgatattataatgtctctcttcataaaaagtgtaaataaatattagaaggtgaattcattgtaggacctacaaaaagtggtttaaaatcacaaagcttgattttctattgaagcaaaaaattggaaagatctctagaatgatatagtattgcaaggtgcaccaaaaagttgacttagatcacaaagtttgatcttctattaaaaatgtctttagcgtgtgtttggattataatttacaaagttaagtttaaggtaacataactttttaacttaagtttatagataaaagtaagttgaaagtaacttgttttatgtttggatactttgttgtaaaagtacttttgacagaatgaaacttatttggattatttggatgaaaagtacatttgatattgttgcaaaggaacaaatggatgttgaggggttataataaaggtcagatatggcttctttaaattttggcaggtaaggaataatgaaaataattatgggtttaatgctggttgtttagaggtaattgctggaaggagttattgaaatttttaaaaaaaaccttatctttctaacggatccaacgaacgttaacggaaaagtaacctatagttgcttcccattaaaagtcggatcatgtgcaattcaagtttagttgaaccctcgtttgtaatggtctcacagtaagttcagtgcaacttctactcccgtttagagactcaaacgaaaaaacaaacacaactttattttttttttcattacgtgcgtttgtacaactactatgaaacaaacatgaaaaatgcacaatttactcgtagaaataataataataataaaaataaataaataaataaaataaagtattttttgaaaaataaaagattgttagtactagttactacggagtatcgtattcgtatcatccaccctgcggcgttgaaacaattttcatggttttgcgccaaataaaataggcgaagaaccctaacttaaaaaacctcttctcttcaagtaacgcgtctttctttcttcttcaactaatttgcattaaaagtatcctcaagtaactaagaaagcaatcaagaaagaaagcttcttgtattcattcattcattcattatgtgtgtgtgtgcgagtacaaaatttatttctggaatctgaggtgtttcatatagccatgttgcttacttgctttagtatgttaattcggttaacaattttttgggtaagtagcatagctttgttttactattcttttagcatattagttcttcgggtcaatggaagacccattacacccttcaacagaaaattgacacaccgagatggtggaacagcaagtaaatgtaaacttatgttataagaataagccactgaagctagataatcagccaccacattagcttctctgaaagcacgaatttattaattgttaacagaatacaatgacattatttgatccatgtagctggtcttacctagtggaaaaggcttctgtttgtttttgttgagtgtattagtcattaatgcaacgtaagttgttgtctttaacgtttgatatagctttatcacattggtgtatatttcaccggagcaaagaagaactggttgttgccacttggaaaaaacaatttgacaaatcagagatgattcaaagggtcctccttctgtatcttgcaaatgacattctgcagaactgtaagcgtaaagggaatgaatttgtgacagagttttggaaggttcttcctgcagcacttaaagatgttatcaagaaaggtgatgatcatggaaagcgtgtggtatctacattggtaagccctttttacactatgtgatgcaagtatttcaactgaatacttaaatgggaaagggtgtaaaagaattgaatataaaatcatagcagatagttcttcatgcatggctgaaactctagatatggtgtataaatgctgatcatatgatttgtttaccatgatattgatctgttaacttagttctttactaactttagattgaaatatgggagcaaaggagagtgtttggatcccaggctaggaaccttaaagatttgatgcttggagaagatgcacctccaccattggaatttggcaaaaagcgatcacgttctgtaagaattgcgaaaagggattctcactccatcaaatcggtgagactgagttactgagggcctttgcaactacatccttcctctccccatttcatacttaaatcattgatgttagatagttacatccttcatagaggtttgctatggttctttcatatctcacttccttgatattgtcttgatgccagaaactgtccataggaggtacagcagaaaaaatagtgtctgcatttcatttggtgctcagtgagcaatccgctgaagatgcagagatgagtaagtgcaaatcttctgttcagcgtgtgaggaagttggaaaaagatgttgataccgcgtgctctgttggtaagcatacagcagaacagagttacagaagtaacaccttaattatggaagttagagttctaatattgtttcttttttcagacaaagatcctaagagaaatactttagcaaaggaactagaggaggaggaaaatgttttgaaacaatgcatagaaaacttaaattagttgaagcaagcagagtagcccttgtatctcagttaaaagaagctttgcatgagcaggtaagttatacacttgtattcaatattttcagtattttattgagttttcggttgttcctaactgtgtctttcaattgtttgtggatttttgtattaggaatctgaactagagaatgttcgtacacagatgcaggtacgtacttttcatgattcttttccacagaaggttgtcatattttgttcatttatcttggtttgttgccatttaattacttctctaatggtacctcttctgcatatatccctaggaagtaattctgaatattctccttgtagtttattttcatgcatatgaagagttaattttcatgaaggtgttcatgtaggtttaattatttctcttatggtacctcttctgcatataaagagttgtgtctggaagatgtttaaataggaggagatgctttgcctgatgaaatttaaatggggaagatcagtgtaatttctgaaacaagatagggtgtttgcgttaagtttcataaaccttgacggaggttagtgtaataatcttgatttatgaagaataaacagttttggttaaagaattgcttagtgaaagcaccgtacacaatttgagagtaaaaaatctcttgttaatattttaatgccgcgtattacttgttgagtctgttttcattattggcatttggacatgtttgcggctttttagctaatcgcaacgacaaatttgaactttattatgcttaaatgtttgtttaaggatatttaggttgcacaggcacaagtagaagaggcttgcaacatgcggaagatacttgacaatgaagattcctctcagaaaacatccactggaaagtccgctgcagtaattgctgccgaggttgcagataagcttgcatgttcctgcgcaaaaagattggtgatcgtaaaaaccattcaaaattaagatcgtgtagtgttggtttgagttgtctaaaatataatgatgtgaaagttttttaaaaaatcgatggaaacattgacttggttcagaattttcttttctatttgagagccaaactaaatacgactaatttaatttgaaataaaaagaatcaattaatcaaattatttgatgaacccctctataaagaataactttctgtgattattactatttaagtcataagatgacgggggggataaaaagtactcgcagtattttataaatgggctgaaactccaacatcaactagactgtcgatacagtttcatactaaactaaatctgtacatatattgtcatcgttatccagtttgagaattgaaggattgcaatttgcaaagaggtcataatccaccctcgaagtttcggaaagaggaagcaagcaataagcagaactgcacaactctgcattgtgcattactgttttggaacagtggcaggaactgtaccagatttgtgcttttaataactgaaggggacatgaggctgtctgtctctgtcacgctccaaattaggattcaagttaagaagtttttgaggatgtaattcaattccattcctatcataagagccgtgtaagtcaaacttatgaggtgggcaaccatacaaacatgaaaaaacacatttataatgttgagaaaaactaacaaatgcagaaaaaaagtatagctggtctatgttcaaagaatgggaaagtttcagacacattctcaagaaactatgtcctcagtttggtcaagttttattcaaaaactttgttcactaaaatatgataaaatggaactaaatagaaaatatctcttctgttgctaaaggtaaagtaaatgctttataaggtgtccatgtggaaagatagatgcaccacctaactatagctcagcctttcattgctttcttcaaaacaaaatctctaacagagatcggtaaatgatacatgatagccatgacagtagagtaatgcccataggtgaaccatgcaggtggtttctccttaaggacagcagctacagtgcttatagcaaactcatctgtaggggttgttttggacttctgcgaaaaataagctctatctcggattgctgcttcaaaaggcttgaataatttccattctggcatgcggttgtagctggctatggcagaatctccaatgtttgatttgatagctccggggacaatattgacaacatcaattccaaaatgtccaagttccagtctgtataccacatgctcgtgttaaagatgagaacaattagataaaatgtaaataattggcacaaaggccagccaccgaatccctaattgttgcatttgcatccactagattttgactttgaagtgcatatatagagttttacaaactccactatattgcagtttccatgaaatcaacacattgatctggaccaaccaaagcctaaaagcttgttcataccaaaccaacaatttctatagaaacaaggtggatttctgtagccaattactgttgcctctagttgatttgatgcagaaatgaagcacaggtgtagagtaacgcaagtttgaagaagaaaaataccttaatgtatctgtcaaagcatgaagagcagctttagaagctgtataagctcctgaccaaggtccagaggccaaggcagcaacactaccaatattgacaatcttcccctttttcttagttgccatatgaggaacaaccgcctgaaccattctcaaggaacctgcatgcgtatgcccgatgaaacatagcatcaagtttaacaagcaattcatggttttgtacaccaaggcaatttttggataaaaattgtgaatgtgattttggaaaatccaatgtacattcttgaatttcaacacacaaaataaagaaataagaatttgtgcatgcttgaatgaaagttaaaaatattgtgtgtgcgtttcaaaaaacagataaaaataaaatagaaacaaaagcaaagatcctgacaaaattacttttttgtctcaaataatttttaacctaaaaatcaaacattatagtttgaggagtaaaagtactttttgagttccaaaacatgtactaattcagtttgcgcataacctttgaggccacaattgacaaataagaatgaaaacaggcaacagcaacttaaatagagtggctggttccaaaatgcattatttatctagctaggagtaactgtagtgaacagaagccatctgcagaatgattaaaatcaatctaaaacaaactcatttggttaatctaatccaacatggcagattaacaacaaatcccatccaacaaatagcatcaaaattccaattaagataaagaatactgaccgaagacattggtgtcgaaagtgttttggatggcagagagaggagcctcggcgagtgggcccacacactgaacaccggcgttgttaacgagcacgtcgatgcgaccgtacttgtcgacaacagcatcaaccaccttacgcacgctctcatcggactgaacatccaactcttccaaaaagaacctttggtcgtgttccagctccgccatgctcgaccgcgacctgctggtggccaccaccctgcacttcttctcagcgaaggcgcgtgcaagcgcgtggcctatccctcccgtggaacatcctgtgatcagaaccacaggtttcggtggctcctcctcatcgtggccgcgcgtgtccatcgtagaatacaaagagaggcagaggaggtgattagattagtgtcaacttgttgctatgccaacaatgacaacccaacccaacccatctagagtacaaaacaaaggcaagacttttatgccagcttttcctatatctagagtagtactcctacaatcaaatgacaagcagctacaaccaattttctctgtcattcatttattacggcttatacatttatcatttatgacaactattaattaataacattatttttcatcgtcaaaaataagaaaaagaaaaactttatttttgagtttatattagatgataatatttatgttttttttagaaaaaaaatgtcttttttatttttatttttggatacacatactatatccattcccttacccacatctaaaactcgggtggaacggtacctcgagtgcacgttggtttgtcatgcttatggacaactaatcttatattctcttttaactgaaatagtagcttaagaaataaaatactactttttttggtaaatagagaaaataagactcagaagacgtcacacttaaaaatcttcttaacaggtttcaatttattcaagtttgtaaaatagattttcaatacttcagaaatgtttgtctcatctcgatccgttaagaccgtaatttgggtagattatgttatttctttactgtaagcacggtaaatattgaaggcaaacttgactacattactactatagaaaaggtacaaagtatgtttgataaccgaggtttcaaaacaaaattaacacaatctcctgaaatgacattaagcctactggctaccggaaagcaatctactcagcagcatcttttttcttcttgggcattctgtatccaccaaccacacaggcatggtccctctcaaatggttcaagggtgacttgctcgaatggtttgaattgatctgccttcaacttgttcacttcgctttcaaacactgcctcggcagggactgtggagtctatgcagttagcctaaacatacaaatgaattcaagtgagaacaatttagcagatagttaagacatagtaatacataagagaagaaactaaaccacttaattcaaggtaatcataaacatttctctttccaatgttttcaatagagggcaagcctcgacacctccatatgtttgttgtttggaggcctgaaagtcccaagttcaaattctaaaaacagccttagagggtaaaagcctgattccttctactctccttagacctcactaggtggggaccatgtgcactgggtcacccttttttaaaatgtttaccatattgattactcaataaagttttataaaaacatgattagatgtctgaacataccttgattgaaataacaaaatgacctcctgctttcagataatatgaagcattcagccccaaaatccttgcctgcaatggtcaccaaaaatcataaacgaaactgatacatagaatataactggtgtttcaaaaatagtggtttgataatgttttaaggagcttttatcttcaaatagaatataattcatttccagaaaatgtaaaaaggaatccacaaatataaaacctatgcaccactccaaccacagccacactttcctcttaaaccagctgcagatataaactatcataacacatcatcacactctctggaccataatccaattgaggctgcttataatatctgacggcccaccccaatacctgtaacaccttgctaatttgcagcccctagaccagccgggggatttaaaaacaaagacagtgtataaacaaaatcctttctctttgccttcatccactccaagaattgaagttaaccatctccactatatcacattctcatacataaaattgaaaaaaaaaaagtacttatagattcaaaatggggccataaacaggctaagaaaagataatccagcactgctgtcaatttaaaaaattaaagcaataaaataatagcaaaaaggaaaagaaaattatgcgcatcagaaactcgggtctgcatcatccatgatgtcttgaaggggaatccgagtaactcatcatatgcacagattattccaatttaacagaatacatgcaagtaaaaaaataatattgaaaattgtaaaatacaaatttgagaaactaaaagaaaaacaacaaaatgaactctaaactgagattttaaaaattctttcattttgaaaatcgaaagttatacacaaatgtaaaagagaaaatgcaacaaaaatatacacgtgtagatggctggctaatatttggcaaccaaacgaaatagtagatgaattgaaattaaacaaacaataatcatatggcactgccgattaagtacatcagtattatggaaaggtagtatgtattgtctgtaaaaacgagactgaaaccaaactcgagatatgttgtaagaaattaaaaccaaacctgatcgggctgagcaacatcagaaaatatgacatcaaccattccgaccagcatcctatacttagctggatgtctagcatcttcaataatgggaataacattagttcgcttctttgccatattaaccaggtcacgtccacttctatgggaaaattctactgcatagacaactccagtcttcatacaagaacaataacacattataatcagcacttctattccacaaatctaagattatgcaattctaaattctaaattttacttacagggccaacaacgtctgatacatgagaaacagtggttccagaagcagctcctaggtaaaggactctggctccaggtttcttcataagacacaagacaaataatttaaaaaaatgaagtgtgatttgaagaacttcgcctaaacatagcacatgttgtaaagacacaatcttacaatccatatgttgtcaactccaccaaggatggcagcagccaacttggatcgaaaaggattccaaactctgtactcatctttggaaccatcttcgttctgcaaaatgaaactatcaattcatgcatccatggttcagtacttaagaagaaaaaacaaataatggtgagaaagaaaagaaacctgaacagtaatccttttctcattgtaaacagcttcaccaggaacaagattcttagtaacaagagcgtcttctttacccttggcaatgaaaataccatcatgtctatggggctgaaccacaaccttgctacctcccttcattccacctctgccaccaccacggccaccacccctgcctccgccacggccaccaccacctctgccacctcctctagctttgaagggagtgcccctgtctcctcctcttcctccaccgccccttcctctgcctctgtcacccctaccaccacccctgaacccaccgccaccaccaaaaccaccacgacctgaacaaattcaaacacttgtcaacaacaaaaaaaaaaaaactattaccacaacattcttacgtcaccaaagaccatatcatctagttcaaatgccaaatgccaaatgcaaaaaccaaaatcatcaaaccacattttcttattaaaaggaaaattacctcttggaggagccattttcgggagctgtaaactgaagtgcaacgcagcagcaacaactggttaagaggattttatagccagccgaacaactgaaatagttagggtttaatagagggtagggttttgattttatagaaaaagaaaaagaaagtgtcttgcatcatccactaacctaaccctagcggtcggcccattttccttaccctgctcacttgttcgtgggcttttatttgggttcatcagtcttcctaacaagcatttattgctttgggccactagcaaggatttctctttcctttctcagctctctacggattaattaagcttttgatattttcaacaaaaaataattaattaaaatcaatgaactcataatatttttttaaaagaactaaggagggtatcaagaatatgatgttcttcttgatatattcagcaacaattttagaatttgctcgagattgatgttcttctttactcaacctcttatttgactccatgatttgttcctcatacaaataaattatttcttcatttgttgtaaccttcaattcaactcctccatttgtgacaacaaatgattcacatccacattacttccacaacccacatattaccccgccaccattactttcaaagtccttgtttaatgatttcttcacatcgtcatcccaaacccaaaatctatagttcttaactttctacaatcacaaacaaacaaaagcaatttaaaaccatagaatagaacacaacacccaataaagagcataaatccttacattccaccaagcacatcaccaaaataacttgtttggatgctagttggtttgtgatattaattaaattgttggcttctcatagagacaatgaacaacaccaccaaatccaattgacgaagacaatgctccaaatgatgccatccacgatgaacacgaacaccatgaaccctacccgaccctcataaaaccactaagagccacccctaactcaaatttgctctctttgacaataaaaacatagattatgctactctactcgtcctagtctcaagtagttcacctaaaaaaccatagataatctaaaacaaaacgataacatttacacaatttactatatgatgcgtatgggcatgtccaccgagacgaaccacatggatctcccacaaaacttttgataagaattcagtgagaaataaaaaaatttcaaggatcggtcacggaattcgtatatattttaaggatctccaacatgtttaagtcttgcatatttattttgattgttataaaaggaaaagggaaaaatatttaaattcttaagaaaataagtgattatttttatttaattttttatatttctttatacagtttgttttaaaagataaaataggaaaactactttcaacttctccttagatataccaatattatactattctcccctctccaatttaaattaccaatcatgtatggagtgagaaaacctcgagcatatgagaaaggggtatatgaatatactactattcgtattattatcaaatattaatatgttccatagaaatttacaaattatttatattctattattattatttagtaatagtagtatagtattagtaatgacattggatcgtaaatgtaaattaaatattatatcattagtatttgtaggaatgtaaaatttaatttaaatgaaaaatattatatgacaaaagttatggtgcaatattgtgcctggtgtgtatcagccatttttttgtgtggcttataacatacttttctaatagattttttttttattgactgaattttattaaaaaaatatattatttctctccaattttatatactttttaaattaatattaactaataataaatcgaacacgtgttaaatagtgttttgtttgctcttctattgttaaaaatttacttttttattggtaaaaaaatactactaaatttactttcattctaattcaaattaattaaaaattatgccctatagcatattatataaaaaatttaaaaaattaaatgtttcaattttttaaaaatagtttcaaatcaagtcttactcaaataaatgtttttcccatcttaaaaagatgcaaaatgcagttttaatttaatgaaaactgaagaatgcatgagagctaaggatgcattattcatacgtatgaaatgacagaaagtcttatctgttttcttggtaatgagaaaagtatgacgaaacgacctttaggagtaatttttttaaaattataaaatttaaataatatctaaaaaaaaataagttatagaatatttaataatttctgagttcataaattatttgataacttttgtttttttttattgaagatataaaaaattatgattttttaatttttttaaaattcaattttaaaattctaaataattttatttaaattaatatttttattttaatttcattttatatttttatatattattttatttaatgtttttatatcattttatttaatataaataatataaaaatattaaataaaaaatagacaaaaatattaaataaaactaaaaataaaaatataggactttgtatattgttttttttcagtgagtatttcttacgagtacttactgaggaaataattagttaaagaaatgggttttgggcattttgggaggcaagcaagcccatcttccaacaagcaaattgtttcccctacagcagcacttggcacaaagtgattgattaatcgctgtggttgtggctgtgaccgtcgaaggcagcgacggagtgaagctccgtacaagggtgttcaagccacagaagaagcagatgggaacttggggattgttctgctgcacccgtattctattttgggtggctgccaggctctcctcaatggttacaccgctttcacctttgacatgagaggcgttgccaagtccaccggcttctcccaagttaaggatgttgttgctgtctgcaactgcctttccaacactttctctcttcccaggattttgttgcttggttcttccgcaggtatgcttcattctcagatctctcacttttcttatactgtttaacatcaccccatccgctttttctacctacaaatcttacacgtatcattaaatttctagagtattcttttaaatttttactgtgaaaaatgttgtctttttttttttttttaataatctttgaactgggcttgttgtttcagtatatcaaatgtctgaattgcttgattagctcctagctgtatgtttcataaacaaatttcgagctttctgtctccctgattacattttggttattccggccagccttatgtcaaatttggaaaggatgccttagttacttgttgcattgctgataagtttagtttgagagttttaatcttaatgccttccaagtttgaaagttgtttgatgtttggataaacactccatgtgaattaaaaaatgcaatgacagctctatcgactctcagtctcaggttttaagcttgtaggagttgaaaggaagtatatatcttttgctcttggattcgatatagactgatttgcagatcaacttgtttcccattttaagtgttggaatgatatccaactaattatgcatgcttgagtttacatggactgttagttagacttgtggtgttaatccacatgcttcttgtctgtgacaatttcccccagttcattcacgagctgctttaggagatgtagtaattcgcgccatgtgttgcatcaatgttgaagcctgaaagagttgtcatatatttgagttatttcttttattacaggtgcacctatagcagggtctgccgttgatcagattgaacaagtcattggttatgtaagcataggttatccattgggaatgactgcctcaatcctttttggatgacaccataaagccatcctacagtcaccaaaaccacttcattatgggaacacaagatggattcaccagtgtaaagcagctgaggaacaagcttaattctgcagcaggacgtgtagaaacacatttaatcgatggggtaggccatttccagatggaagggcctggttatgatgctgagatggtggatctcatcatcaagtttattgcatcactataaagacaaataactgattgtgctgagtgtgatttgactctgctattgggaattgggattagtttgtgtacaaaatcttgtcagaatctgcgatttgcactgtttatttgtgtcccctaagcccatgccaccttctaaaatgaaagaaatcagttacccacatagtaaccatttctgctgattggataatgagagagaatgggaattgcaagcataagaaccatgcttttcataatttataatttacaaataacatatctgttgtctctctagattgaagctaccctagattgaagctacccgctacactacttaatagatacaaaaagaaactacaattatacaataattatatcatattacaatagtcatgccttgttgccaacttcgtgcggatactcagatggagcactagtttctcttggtaatttatcaccatttgaaccgtctggtactctaacaccactcgaattatactgttgtttcttccagtgtttttcctgatccattgactggtcttgcgaaaagggaggttctacatctggctaaagcaagagagttcaaggaacataaagaatgaaagagtcttgtaatcaataatctaaaatatcaaggaagttatatactagcaaaagaacaaagaaaagaacgtccaaacgtccacgctttattcacagccttgcatttcataaaaaagttcattagatcccccgagttgctggcctactagcaatatccaaaaattaagatacaattcaacagaatttggtgaaatttcaattaattatacatgaacaattttctagttacttagttattaccactttcaccctcagacacatctccgagcctggtaattgcattaacaagagcctgttcatcttcctgcatttcaaagggagagccatcatcattttattttattttttgatatagagagccatcattattgttgaaactaaagatttctcataacataaagttgtatactaagaaaatgattgatattcacttttagcattttctttgctttctccatttccatgggatcaggatggcttgcagtaaacaccttttcaacctgttttggttccattctattaggtaatatgaaggagccaaatatttgtatcatacagagaagtagccaaatttaacacacaaatttggaaatttctgttccagatgcttgtacctccttgataagggtatctgtatggagtatctcaatatcatttgtagccttcttcctgcccctttttgtgacaaagtgaaatctttcttaggctgcaccttcatcattcccctacctcttccagaaccagtaactgcaccaccgtgaggcatagacttcttcaatcctctacctggaccgggccggccacctttaccagatattccaggatcttgaccctcccaacgaatatcttctggagatatctaccatatcgaatagatagtaactaggatttcatcactgattgagttgattgttagcagcaacaacacaaactttagtctaattgataaagaataatgaatgtgaagagacactaagcatgtaactatgtatctttgaagtagaggtgtggtctgatttttaaagacaatcatcccgtatatgcttgaagtttcattgtttgcattaattatagatacacaaaaaagaaatcaccaaagcaaatgttgatccaagatagcaaaaggacattgactatatgccaatcccttcagccacaaaaacatactagattttagttttaggcagaaaaatgttcatttcatcaaaatcatgagatacttaatacccatttcaaggtatgggattcaaagtatgagacacaaggtcaccatgggaaaggtaagatatgtgaaaacaaaaggttctagctatgcttgtcaggagagaaatgttgcttaaaaagaaaagaaaagaatgaacgacgctaaaactagattgtatgtgaatgatagacagaagaatattaatattgtaaaattgacctctttaagattgacccactcccatgtttcatttgctgaattcatatcataaaccaaagcatgtagtccctacaaaatatgtaaatagaaatattaaaggagtccatgcattcctcagtttctaatagtatactataaacacacctcagcagcattgttgttagaggaacaagcttatgagactggattcgaggccagcacctccagaaggataagaaaaggcaagtgtaagaaggaagcttgataattttcatatattccatttgaattacaattgctttatttatactagttcctggcaaacagaatttgtcattttgtaccaagaaatatttaggaaatcattggcctagtgattacggttgtgatgctgtccccccaagaccaaccagccacgcttagcaattccagagcaaattccttcattcgaaccttcttcatacgtagtcactaaggtgagagggccttgtgatgaccctctttgcctttcttgctatctgaacccctctgttctgtgcctgcacctctgtttgatgttctttgctagctgatgatcctcttttcgtatcaattataatccgttataacagcttcatagaagtggtggtcttcaggccaccttgtccaaactttccttccaatccagggatcataagaagctccttcagcaggtccttttgctgcaaaggcacctgaagaaccccctgatcctggctttggcttgtaagtcctgtagaagggaactgtatggacatcattgaggatgcacaaatcaatgggttttttctttagaacgggatagaatgaccatagaggaagtgtaactcagtattttgttatcttgatattccaaaacaaaaaggattactgatttttgctttgtggtcttagttcctgatggaggttcatgcttcaatgcggatgatgatggttgcatagatggatgaactgcaggagatggtgcacccaaggataatgaagccacagattgtgatgtcttttttttcttacgagatgccaaaacggtagagctggtattgtgatcatgaacctgttgagcagtatgtactgttccagattggagcccatttccctttctccactccctaacagcacaattggatacaccccactttaaaatgcagaaaaaaccactgtttgctcaatgctatacagaaactgctcactagaatatgataaaatatagtatgaccttatcctgtggatgatgtcatcagcattgactcttgatagaagttctgtgttcttcatctgatactcttagctccttcctaagctctgtaattaaactttctttttcctaaagtacataggaacaaaaaaactcattgccaatcctatcgacatacttaatagaaagacaaaccaatgaattaaggcaaaggtgcccaagtgattgcatcagattgagctttaaaagccttcaggacagaggtgtatgcttcttgctcaatgttatggatttgtgtttccatgtcgttctgcatccgaggatatggaccagagcctacaattgcagatcttccgtttccagttccagtggcatgatcagggcgttgaaatctatttcgacattgatgggaaggaggaagatcatcatctgttcctgtggttatttcagattatggaaattaattgcaagcaaccttttgaaacgttcactcatataatttccacatctgaaatgttcactcatcattctatgagatttatctttatcaaagaaaatttaggacagtcggacagatcactatcatggtctgtacttaacattgtgcacaacaattatgcctgtgtgatagatatcttgtgttctataacgatgataataattagaaaggagcgacatagatattttgtacgaaaaaaattgctgccttgattgatttgtgtgaatttggtattggggagctggtagtggtacttattttgattatttatggtattccccctgcttcaaatgcttgacaaaaaaagacaaacctgagaatatgctcatttcagttatgaatcagacatgactcatttccactttttggcaatatattctgttcttttcattctgattttacagcaagtgttcattatcaatgacatggtctgcgtttggactaagatgacagatcacgaggaaaaatgcagctagttcatgtcttttgttcttgctattttcctgacttgttctcagttagaaccgttttctttgaaacactataactgctccattatttagaattaaaagtaataagaaaattacaaaatcagccttgactgtgttcatttctaggatttaggatataaataagtgacaccaaagttcaagtcttttaagtgaagacctcaatctatgcataataaaaaaattaggattagcataaaggagaggtcaaacgaagttattcaagtcagttgctcaacacctgcataattttgtaaccatacatacaatataagcctgcgaagaatcaccagtacattatcaaacaattcctaacttgaagttaactaagcaatttgataaagaaaaccaaaatcctaatttccaaattaaggtccaaactcattctagtcattatctattcaaacaccttctccaacatcacaaagcagctacaattattctcaatattgagtcaacatctcaaatgaaaagttcacaaagttgcagtttcaggcaacaaagtttcaacttacaacaataacagcagcagccaaacggtttgttgaggaataagaatagcaaaagggctatttcagacaatttcctcaattttgttcacacggtcattttaatatttgaaattataatttattagaggccgggtctagccaaaaatattagtccccggtacatccgcatttaaaccttgaataagattgtcttttgaagaataatacttataagacactcaacgaaattatttaaaatcatttgattttattattatgtatttattaattttacacaaatagtgccaactaatgtatacccaagaatctgcttggaaaaagttaaatgtatactcaattttattttgtatgcatagagagaaatagacgaggaaaaatataaaagaaaagaaaaaaattataaataaaacaaacaacataataaaaaatgaaaagaagaatagaaggaaaaatagactcaaaatgagattttgaaattatataattaataatccaattaatctcatgagatattattctataactataacttatggaccgtttggaagagataaaaaaagaaaagaaaatattgattacaatatatttttctttgtttaattgaagaaaaataaagaaacaattgacttctaagaataaaaattcaaaacttttcttatgttttaacttttttttaatttcaaattttccttttcttgattttcttttcccactacaattgactgagtcagactgaacgtgatacttagatacatacatgcaactctcagtactactcctcacctctatataatcttcactctttgctcctccttttcttcatccctcagaattaacctcttctcttctttgtgccgaggtattgctctctgtctccccccattttttcctaataaatgcactattactccatacatttgctcctcatctctccccactctttaactaataagatttttcctccgttgtgtatgtgtatgtgtgcataactcgatctcttgatgatttctaccaattggcctcggccttatatatatatattctcattctcatatatatatatatgtgcgtgtagtttacatgaattttgcaggtgattattatttgaaagcaaatttatttatgctgttagtaaagattgcagcaagattttgccataattaaaaatctactttaaccccattgccctgcatgtacattttattattagtttgtttgatgattttggaattttgtggtttaatttattaatatatatatatatatatatatatatatatatatatatgtatatattttgaaggaattgaggagcggagtatatacgatgcagttcggattaagatccccagaagtaccagatgagaacacaatctcgcgtggaagcatcactatacagtttagcttccatctgagtgcactgagcatgatggagtatgagaaccatcggagagtgagaacactgagcacaggtcccttcacactgaaaatgataatgcaaataaactgtcccattcttgctcatatctgttgtgtagataaatttaagtggcctctaacaaaggacactgttgttctccgagtcaccactcgcacctatgtcattgccctccctggcctcttatatgccctccagttcccaagactttgctctcgagaacgtcttcgaatcctctcaaatgtctttaggaaatatggtcacttccaggatcttagaccccaaaagctaggtatctctcttctcattaatttcaactttatttaaattttcgttaccattgacttttattgattactatttgattatttgattgactacttttaataacattatttcttttgactacaggttatatctatccataacgcttgactgttacttagaccttcaactttggattaaaattttaaaaataatttttgaatttttaaaaaatctaatttattaataagaactgctacacatttttttgcgtgaatgcaaggggcaaaagcccctagaactagattaataccctctcgggaaaaccgtggaatttacattagatataacagctgcagcaaagaaaggtaatagaatcataaactctcggattctcaacaagagacatttcatggttagctaactctcagttacctgattcccttccctcaagacaccatgattgaaggcactggactatactaaagaactgctacacatgcgtatttttatttttttaaatgacctaattacaaataaatttgtactaattttcttcccttttgcgattgggtgcaaaattaaatttatttagacatacgatcgaccatttgtttgtcctacatcctattatttattttgagaggatatgtccttgtcctaattatatatatgaatgaatgatgacattgattataattaataattaattacattacatgcaggtgggtgctcaatgcagttcgatgacccagaaatgttggaagtgttacgtcctgattttgagcccatagcacatgaaacccttttggagttagggaatatcccagggatttcccgtttctgcatggaagagcagaactcgagcttcctaagggcgtgtcgcatgtcggcgatgacaaagatgataatggaaagcatgcgtgtgaagacaatgacaagtagtcttgtggagatcaaaggcaccaacccacctgaggcacaccaaggaagagcctatgctgtgatgagtacctacactcgccttgttgattctgctgaatacgcttccctcgtttcctgtggcttagttgaggaattggagaatgttgtgtctcctcttcgctttggttcggttgatgttgggtaccaggtttggaatctcaatcacttgggccttttgtctttcatgtctctcttgggaccccatgttgaagaggaagtgaaatatgtgagtgctagagaagagttgtggaatgccatggctgaaactgaacaggaagaagaagctgatgaggcctctgatcatgatgaagataagggcgaggaaacaaattaaatatcaatacataagtctggctagatcatgtatgaggtcttggattctcacatttatgttcgtgtaataatttctctttaacaagagatcgagggtaaaacatatgtcttaattaatttttcattttgatattattatatattctctactattataatatgatgaagaactaaatcatatgaattgattgattttttaaagagtacaatcgtatatatatggagagagaatagggaagtgaccatatgggatgaccatcacctagtaataataaggcaagctaaagaaatattatcatgataactgttgggaaaatggaatcggtcggaagcatgcatgtggaacagatgaaattaaagctagcttctcaggaataatatgaaaatctatgtcaatatgctagcttttcgcaatcatgaaaattaattagtattggatatattttcgatatgtcacaatacaataatgcaggagtgaagaatggaataaataatcttgtagaaggtaagtcagtcattgaaactcacatgtggtagagagggctgaaaggctaaagcacgatattatatacacgatttcagacgaggagcaagacagtacatatataatagtattctgtttcttgaatttccagaaaatcaaagagccatcgaggaacacacagaatccggtgttgtatgactagatgccaaatttgaattactaaatgcacgtttagtattgaagcgaatattcctcttagctgccccgaaatgatgaatggttggaacctggttgaaatggctaagatgctaaacatcatataggttattatatctggtcttatgtttgtcaaatgaagaagacgtccaatatatttaacttttcccagctagctgctgtaacatatattgtttttctcgatatatcttgaaaggtttttaaaaattcaaagtgattatttctataaaaaaaaagtttctaaaactacaaaaatgttgtatacattaatataattaataatttcagtgttagattgattaaagttcgctgatataacttttatttaatgaaaattaaattgttagtacaaatattgcaagtctttattaataatacaatacatcatactaacatatccaaaatatttatactaattaacagttcaatcctgctagataaatgcttttctatatatacactgacagaacagttttaatgcttttttaattttttcctgtttgtaataatgattttttgtttgtttgttagaaattgacatttttttcactttaatcatgggctaaatcttttatagtaaacaaagaatataaaaataaggaagtttaacttagtttgtttcaacaatataagtaaattattgtaaattctcttatatctgaattcctacatattaaaaagaatattacaaaaataagatgtatattaatttgatttgataaaaataagattatgcaagatttaattaataaagcaaaataataaaaacaattaagtcttttaaaactatataaagtcgtctatttgaactaaagttatcataacattttatggtgaatcatgtgcataaataaattattgatcttttaataattatttttaatggattcatcaatagtttttctcagtatccttctacctctagtaatatggccatcatcatcatccttttgatctactctcttaattggtattttactagtttttacatagatgtcatgtctacataactttatctttactatgatttttctaacaatatattatcttgtatattcactcatttagtgcatccatatttgtaatatttgtttttattaatgttcaagacactccttttttgttttttaaagttaattaagatactcattcatttcatctatcatgcttaaatcctctagttaatttacatttctttctcattctatttgattgatggatccaatacttcagcatgatgcatcgtattattggtgacaacttataatagtcatactactattaacaaaagataaacttaacgccttgtgcaaaagaagattactatcttaggtgtagtgtatattttgtgttgttttgtcattcggaagataataataacttatttttatcttactttgcgacaattcaaaatctggtatgtaatttgtgtatgtcaggtattttgagatgttgcataataatatttccgcccactatatacaatttaactctctttttggaagaaaaaaagttgaggattaattgcaacaactatatggtgatccttttaacttcaatacgttttcgacttgatcgataaaagttagatcataaacataatttaaggtcatgttcttttttctaatggtgtattgatatctttatttatccctttaattttactttaattgtaagttagactttactttcattttaataaaattttactattaaaaaaatataaacttatcccttaataagtgacatttgtttttgtacaataattaatgtgtcttattttaagtggtggttagatccaatttcatgttgaatttaatattgtggaacaaaaaggcggtgttatatatatatatatgatggtcgatggtgcaagaggggatcggaagattatacttaaagaagcagaagcatacttgtactccaatctaataaaaatgttctatatataatagaaaatacggatacgtgctgtacaggaaaagaaaatgaatatgtaagtatgattcggaatacatatgcaccatgacgcttttaatcatggatacaaagcagcaaagccctcttttgacataacaacacattcaattttgagacatgcatgttacaaacgactaaaagcccacgccattaataacatcaacagtcttttatcacttctatatagtaactaaacaaggttttttttcggtgagcttaggggagctagtcaaacaatcatttaaaacttaatcacacaaaacatgtagaggtatagaaaaaatacaaaaggtaatggtgggcaagtgaaaatccatagttttggggagttatttgtatcccaaagtcgaaaaccattatgccctaaaggcattatcggatgtgactccttgttcactacctggatgcaccttgttctttcccacactagaactagccacctttctctcttcagtactcacctcacctcttcgtactctttccacttccattctcttcaacttctctttctgcctcttctccataacataaatttcagctgaacgtgccccaatggaagacatgttgttctctgcaaaaacaacaaactagctaatattgcaaaaaagtttactaattattagacttggctactaagaaatgctttatgaaattagcattgccaaagatggtatttataggagttggaatttgatgagagcgtgtggaataagcagccacgttcatttctccaatgcccttgtggtttgtggctttgctttacaaccaaccataattaacattaattatcttaattgcactcacacaaaaaaataaaatgccatgttgtcatcatactttgcatggaaaattaagttttggtccgcgcaccatctttatgtgttttaaactttctaaatatataagatagacaatcctaaggctccaaatgcaacaatttgtattaatatattacataagtatttaaaatacacatggtttggatcacacaggaagtggattaaatataaaatgaccgaagtgggcttcttagtttaattatgtgtcatccaaacattaaccactattgccacacagatgacatgtcagcttgagatgataatatattctgtgggaggagttggaggctgcacaatggcagatatattgcatgccgctgactactggtaagttacctccaaaataattgacctataatattgcaaaggccattaagttataagattcaagtgtttcaagcatatgcagtaacctaaaacgggtttatatataacgaatatataatttctcatcgccgagtaacagacgtacaagaatgagacagagagggaatgtaagaatcattggtacttaaatctttgattacatcgatgaacaagcgaatttcaggttttagacgggatgctttaattttgtttattattaatattagttcatacacgggacactttaattgatgaccactaatcgtggaaactgcagcttctgtattagcgttttaggtaggattttaatattatgcacagcaccaactaagcttttagacgtatattattaaatttatatcttaaaagcataagccattaactgacagctaggttatcataaaaccaggagagcttatctttcaatctaacactttgattgcatggtatttctcttcgatctaatttaagttcttctttttcttcagtgactattaaataaattgtattaaataattataactcatactctcgatcaggtcaacttagcgaaaataagattggatgatagtaatatatatgttagtagtgtacatcgatctactctaagactaaagagcgtgtaataatataactaaccagttgataagattcatattttacaagaggtgaatttaaattcgaatgtgtaaatgtaaaaacttcgttggggagtaatttaaaaatacttatgtaagtactttgagttttaagatctgttatgatccatgtaaactttcattactcaacttacttcttttttttagtgaaaaaaaacattatattaatagcatattttcaaggaaaatatttatcatgaatccacttactttctctttcatctcatttctactttcattttcttaatctcagttttttttattggattacctattatatctatcattttctccctttattttttttttcttcttattctcttttctttcctccctaacacaccccattttaggatgtaagtttatgattactttattttcagatacatcttacaataaagaaaaaaaaagggataaaaaaaaccatatattactagaaaaaacataaataaagatggaacttagagagggatcctcatccgtctttagtagagaccaaaacagtgacaaaatgcaatatacagaaatgaaacaaaaatattctaccttagagacaacataaggatatatccgactctataatattccatcgtctctatatgtttaataatatttggacacagattttagtgacaacattagttagtttgggataattgtcaacatagcccatctctaaactcgtttctatgtatctattttaatattttaaaaattataattcattagagactgaaatgattccgtctctaagattttttatattaccatttttatctattcaactagagttaaagtatatgctgtattatagtttgattaaaaataagtactcaatattaattataatattatataattaattgggaactgtacacatgccttaatataatattattttattatattatatatgagtatttatatttttttaatgtgatggaaaaaagaagataagaagaaaaatcaggtgagatgatacaagaatatatatatataataattccaaatgaaataccacaaacattatattagatacatgttgacatgaaacaagtcactccaaaaataatatatattttcaatttaagcttattgttgtaaataataaaaacttgagcagaagaattatagagatgcaagttgctacatatggtcgataaccatctcaaagaaatccttttggtcagtctgttggcaacccaacatatcattggtgatttggtgtcctgtctagtaatttgagattgtctatccgctctaccactttctaaacaaaaataaaaaataaaaactacctcaacaaaatcaatgcattaagcggtagattctgcatacagtagtatagcactaccaagaaaaaacttcatatagcaacgttgctctcgtaatatcacccgatattatttataataagaagagaaatagaaagaaaaaaaattggtgatgtaataatataaaaagaaacaaaaaatgaataatgaaaaaaatataatttactctttctcgcatagaatgggaagcaaggacctcccagaaaattttgaaacgttaaatatgagtggacatgggaagatgtgataaagatcgatccgaatagcgtattaggaggataatttttataactttttaatttataattgttacgagggctaggtagtgactttttcttcttttttttcaattcaggggacttgtgctgttgtgcagtgtgctgcaaaaactggagttttttggtgtcaaaggaaaagaatcagaccagaatgaatttgtgcctagctaccctgtattgacgaagctactgtatgcgttggggaatagcgcaaataaaatgatttttttgcaacttcgagtcattccagtcgcagtaacgaaaagaagaatatataggaaggttcatgatatatatatatatataatcatatcgtataactttcataactattatattattttttaacttttaattaaatatttaatattttcttaaaatttatcattaaattcaaaattcattttatataaattatatatacaaaatctaatattaatctaaaattatttattattttgtttatatagattaaaattgatctatatgaatattttaaaatataaattattgattatttttttattgttgttcaattttaataaaatttgattcaaatgatagtaataatatatagatataatttaacgattagattaataaaaaaaatatattatatatatatatataattataaaaattatatttgtataatttaatccgactttgtggctatatatgtgtgtgtttttgttcatgttgtatttctttctttctgcaaaccatatagcagtataagtgttttgtaatgtacatcgggcacaacttgtgcttcttattctttttaataaatttgatccattagctgttttttaaaaaaaaaattgttgaagataagtacgtatcaaattttcttatataaattatgtatcaaacgacataaaaaatatgaagcagtaaaattacaaatactttatggcaaatgataaacgatatcttaaaagtattattaaaaaacttaaagtaaaaatatttttattagaaggaaaaaattatattatttacaatattttttttatcattcttttagaatttacaaaataaattttaatttcttaaacagatcactggtatgcaaaatccatactatatatatatatatatatatatatatatatatatatatatatatatatatatatatatatatatatatatatatatgataagaacctcctcccttactactccctatgcattagttgttgactaacgccacttaccaccaatctcaagtgcttctgactaagtccaattaataaaggcacaaagcgccatcgtgccccgcacaatttatgttaaaaatgaatacaaatcgaaaattagggtaaactgatgtaatttttagtttgtggctgctcaaagactgcgagttatatataaggatgaagaatgtgcaatgcaacttcccaagtcagaaaaattccatgcaatcagtcttcttctttgattttatttttcttttgcttctttataacgtttttgacttccgtgaagtggcaaaggcaacatattttgtgtattttattttttctagtcagaattgagatactttttcttcaacaaaaaatgccattctagtattattccaatatttatactgtagtaattcttaccatttcgtccacttaatttgaccggctacccattcctgttctaatttggctcaaccaccgttccgttttaagaattttgatccaaacgcgcacgtcattccaataattttataatcttaatttaattgttttcctccttctcgactgcgaccaaagtattcaattcttaaaggattgataagacaaaaagagtattacccaaacaataatgcacataaatagtgcttagcacctaagtcaacactgtacacctaatcacttgtttttaaatcaaaaaatattttttttatacttaaaaaaataccgtacattgcacgggtttggatggtagtttgtatcaaacaaattaagcaaagataagtctaaccgcttcacggggcagaacgagaaatttttgtattaaagtcatgtgtttatatgtaaaaaagcaaaaaaagtattagtgcattagtttagttgcatttagttagcatcaatatgaaacctctctctaagctcttaaacaagctttgtgggaaaatgataatgctattagcatcccttctaatagagcttatcattctcattcagaagctaagggaatcacgtcccatcagcacccgccaatacatcaaactcatcgagaagaagaaccccacaatttgctacaccaaaagatttaacttgaaggcagagcacgctacagagtgcagggtatgcttgtccgaattcgagcaaggggagaagctgaggaagctcaaatgccaacacacgtttcatagggattgtttggacaagtggttgcaacagtactgggctacgtgcccactttgtcggaaacaggtgttgcctgatgatgttgtgttcaagcaccgtcagcatcagaatcaaccagaggctgcttctaatgggaatcatgacaatcttctctatcttttttcagcatttcgtggtggcaacacttaatttgcacagataactctctctctctctctctctgaattacccaatgtcttcaacatatttatagtagtactatatagttaaaacaaaaccacctaattattttttctttttagaaaagggtttaatttgttattcttcccctgccaggattctacggaggaatattaatattgaagtacaccctatagatatagatattattaaagcatcgatgctaccttttttgtatttcactcttcttctgcttattatttggattaaggtttgactgatctagaaattcatattcatatgtctgtgtaagtggacattttaattttggggttagaaacatccggcaattgtgatggaggaaacccaacttcctactgacggtagagttggttggtcaaatgaggtagtggagtctctcagacacatattattcatattctactcatattctacgaagaccctttcttagtatactgataaattggtaggtgaataagttgaaaaaagatttttttacatccgttgacgcctttagagagaaacagagacaagaagaaaaatatagatatattaagtgatatgatttaataggaaaaaaagagatatatagaaaaaaaataagagggtcaactaggtatttaaaatttataggtataaaaaaatcaggactcgaataagtttatggtttgatgtccagaagcaattcttttggattttcataaaagttgctttaatgttaatatggattaaaaacaaatattaattaacgatatattaaaatgaaagaaagttagtgaattttctcaaaagtgaaaaacatagaattatacagttacacatgcaacataaaaaaaattaaaacaatataggtttaggttgtaatttgttgaaaaagattatgtttggatcttctatgactatgagcacataaattgtgcttagcaccaaaagtcagtaaaatttgcttaaaaaagtatttcaaaaatagcaaaatgatacttaaatctatttaattgcataaatccaataaaaagggttaaagaaattaacatcctaagttaaatatatgcttaaaaggtaagcgtaaatggtaatgataattattgataagttgtctttcttcgttccaccagcttaaattaacttaggtcatgtttgtcttcacatagctaggaaagacataagtcctcatcggtgatctcaacttaacagacttgacttagaaatagacgttgccatcgctttcgatcatttgctaatcatgtggcagaaccaaattaaggagaatatgtagcctaggacattaattattcaatatggttgagaggtagatggacaaattcaatatcataggacacaggggatgcatcaaactgacactttttgggatcaatgaatcctcaattggtttttcgatttctgtagcagtaaagtgcgataagaattaatttgtcaatcttcatattttcataaataaatttgattatttattcttatattatgatttgtttgtcaatgaaacaatataagaatgcatcaaacagtgttgaaagtcgtaggttttaatggtgcactcctatcatactgcaattagctaggttcttaactagtctctgacatttttcaacacatttgcttggacagttgggcaataaaccaatgggttttgatgtaaaaaaccaatgacaacaacttgaagtaggtttactcttcacatgcatgtggtcgatgttgtattattgattatatcaaatgctattacaattttctataagttttcctttgcgtattggcagaagaataatcaagaagggttctcagttatgaactttgcaagtacatatgatgcgtgttccctaatccttgattacagacatttcccctcaaattgttcatccaaaatgaattatttgctccttctttttttgagttgaaagagacataagttcaacgttgacttatttcctctacatgtattcacatcacatacgtgataaatgaattgtagtacttacacaatttttttataatattatttttatttttttctattacatacattaactatattatcacacgtcccaatctcgctcttttctttcctggtctctttattatacatattctgttatgaaaaattgtataaacataatttgtcgtaataaatttcaaattacaaattgtaactgttatatatttagatgaataattataatttctcatctttttttttaaataatttttcttataattaaggagctaaaaatcactcttagaatgaataatgtgagatgcctacccaacctcaaaagctagttttgatacgatgttaaagtgcagcaaagacatctaaaagatttttttaaaaatcaattaataaagggatgacctatccaattatataaacacttatcatattcattaaccacccgatacggctctcaacattcatcttagaaataaaagcttcttgtatatcaccaaaagtttaaacaaattttgtggacaatgaaggatcattggataatcactgtaagcaacttggtcgtagtagagtcagtactagtttttattcatctactcgattatactagcaatttctatttcattccattgcatgtattaaaatactactagattatatgaaaatgaaagtcactgggttttattatcatagtgggagtggattagtggttgaaatggtagctcaaccgatcgatgtgacggttaagaagtgtcggtcaagtagtgaacacaataattgatttacaaaagcatatgtactccacccactaactcttgcgtgctccttgtttcaaacaattaaattaatataagggtatttgttagtgtttaggatattggttaagaaatcaatatatatatatatatatatatattgtataaattataagagaatataaaaaaattatgaatagtataattttttgtttttcaatttttaaaattttaattaaaggaaaattggttatatttaaaattattctttatgtagaagaaaaattgataaatgattttgatccagtatatgtcccaggggcaaggggggaaataacagaggctatagctcttcaagtactgattttcaggtactttgttggagtgtgattctaaaatcgtggttcagtttgttaaccatgcgtcaacacagtactcttcatctttattagtctatcgttacctctattcgtcattggttggacaagaactgtgaggttcatattgtgcaagtttttagaaaaacaaccatgaaccatggatgctgatttttttagcatcagaagctcaattttaggagatataggagttcatatttattcctaaaccatcagaacttgattgacgcaatattaatgagacttccctaggcctggtctgttcaatttgagatactttctttctcaatttttttagaagaaatagtagaaaaataaataaattatgagtctctggaagaagccgtaggaatataaacttgtagatgcatccacactccaatctcaataataacaaatattccaagtgaagtaattattgaaattatgtctcatttgttggtgaagtcgctcctccaattgagatatgaaattttcatgactgtgagaagcgtagccaagtgtccaggttatgtgtgactacgatgtcactgacatgaactatctcaaacaatgcaaaaattgtccccttaaaggcaataccccctttcccccccttaaaatttggctttcaaaaagtacttttttcaaaatacattaatttttaacatggctagaaagtatttttgaaatattaaaattttaacacttccagaaaatattttctgaaatgtgttgaaattttttaatctgttttgaaaagtagtttccaaaaaagagatacttgtagaagaagaagaatatatatatatagtattagtaaatctgggaggtgtaaataacagttgttaccacctaatcttaggctgtaacttggtccacgatggattggattttaatctcaaaggcctagtacagtcgacagatatatggcaagaatttttaggtgagcacacttaagactatgttgaatatatggaataaaattttccaacttcaaatttcaaacaataacaaataatccatgaaacaaacgactcctatactcttattgagtgttgatcattgatttaagtacttacaattaataatacatatgaaaagaatatatatactatcgaagaagtgaccagccataaaagtgttggatttccataagcctctcttttaggcccaatatcataaaagaacgggtcgcacaggtccaaataaaacaatagtgtcccaagaggtggcccagcagtacacaaagagacaacaaggctttgttattctattctcccatccaagttcacaccccatattttcttttatttttttaacaaaaatatccttgacagacacatttttattatgtattgtacaaaaaaatataatataaaaaaaacaagtatttattgtgttaaattttcattaaaaaaaattaacatgactgaaacttattataacttttttacaaaaaagtaaaatgacactattattgtgagtgaaaaaaggtgtgttgttgtaattgtgagaaagtaagtgcagaatgtggcgtgagaagaaagtgatgtaggaaaatggacttggtgagtgagaaagtatgtgttactgtaaatgtaattgtgagaaagtgagtgtggtgtgagaagatattgatgtgagaagatgggtgtggtgagtgagaaagagtgtgtggtgctgtaataattgtgagaatgtgagtgtggtgtttgaagagagcgacctgggttgttgagaacataaacttctttttgttgttttagtttaaaataatagcaatacaacggaaacatttatgtttttgttgggttaaatattttttaaaaaaaaataataaaacaaaaactagttctattttgttcaatcaaaatatatttttgttgtgtattaataagggttatcatacattataatagaaatatattttcattataatagaaatatattttgattataatgaattcacaacacaacctagtttttaaaataataataaaaaaaagctgtggtaagaggtggaggcaatgggacccataggggccatggccccctcccctacagatttttaaaccttcctaatattatgtataattaattaatactacttttgatgatattatttttcctttggttttggtcaagatgtgaaatggtggtgcatgagtgtaggatgtgcaacaccaaccaggttttacaattataagtctttaggcatttgatgttttcagactctgtttaattggtctacactacttgagttgtcaagttgtaatcattgccatcttaataaaattcactttgctttaaaaaaaattaatggctctgcaaattgtaattatttacacctcacatatgttctcattcctttttctttctaatgtgtgtaaaggtttttgcattgcatttcattaacttgtagaaaaactagttttgaacacataaaacaactagtttcttttaataataatgcttattagatttatagtttttgtttttactaacaatacatttatatttagctaacatgtctaactgttttctgccaatttttataatacctatattcatgtaatgaaactcctttttcactaaattaatttaaatttgttgtggttaattttttcttttttttggttgagagatgtttaagaagaaaactatacatatagtaattttataagagaaaagaaagagatgatgaaaaaacacatatggtgtctaatgcatttacttcaaatttagatactatgtttttattgacattattggattgaaacattatactttgataataatgagatgagtgacttattgttgattgtatttttgaagtttcatctctattttgaagataagagatgctatcttttgtcacactttttttaggatattgttgtcagttctttattctcttctattttttttgttattcatcattgtgtgcatgtgtattgttggcacttattggttaatcttctttactcaatataattatatatttcttctgcttataagaaaatatgttaaatttcttgcatatattatgcatgtgaaaatttaattgttttttttttctaaatcaagattttttattagccccttaataaaatcctggctccacccctggctgtggtgtaattgtgtaaacttagagaaaatgtgttgagaataacacggttcaggggacagtaatgcaaaacatgtacgcccactctgctaaaaaagggcatactaaaacaggtctgccatatatttacttctgtttttcatgtcctgctaatttcttgtttaatcaaaatatctatactaatttcctatagagtttacactaaaatttatttatatcaatacatatccctccaactccaagagtacatgtatgcatgtacgtgtgagtaatgagtttctttataaccttctagaatcccagacaatctaatcaatagtttaaaaattacaaaacataagatcagatatgtcaaagtatatatataaaaaggggcaccggagatgttaaacggggaacacatttgcctttaattcaaaacataactatgcacagtaacacagagaaacatagattacaaaaggaaaaaataataaaacaacaaggtgccaacaacagccaactattgcaaccagcaagctgaagttgttcaagcagaaaagaaactgttagaagcagcaattgcaaattgggttttgggttccaaaacccacttgacaagctccttcttctgcacctcaatcttctccttcagaaccaacaaagaagcacaagaaaccacgttcaagttcctctcttgtacagcgccagccttcttaaaattcattgtcctcctctcatattcttctgctaccaacatagcaatatcagacatggttgatggtagattctctcactcactatatatgaaacgatgttgtttgttgtggttaagggttgctcttactaaaaccttgttcaaagcaaaagctatttatagcgacggattctacgtctctacgcgtggccggtcaacagtttcggataaggctcaagccgtgttaggtttcgattattaaattattactcattactatacttttttagttggggtgggtcatatccattaatgtgtccttcgttaaaaaattctgaagactttccgacgaaatatagaggactaactaatgtttcttcaacctacccatgttgttcacatgccctgaatatgataggacaatttggacagatctaatgtgggagaattataaaaaggggactgaaaataagaaaatgttttcatatataaatgttgtacaaaaaattgtccaataaggaaaataagatgatcgatgcaataaaaagaaaataataatattataaaattattgtttcaatcaatttgtaaataatagaactaaaaaggagtttaacttttaaagccaaagatggtaaatgtaattcactttttaaattaacaattataattcctttttcaaaaagtatatttttactttttttcatcattaattatatttttactttaaagaagttaaattttaaaaagtgaaatgtggtggtaataatccaaacaagagttttgcatgatttgtaaaatattccattctctgtgatcggtcatcaaattggaaaatgacaaaatattgaaacgtgggacacgtgtaacggtttctcactgtatacgtagtatagagacaataagcaataatgtccgacatgcacatgcccaagcctgtccctatcctttttttttttcagaagggatcattaactttggaatcctaattcctaaaaatgagatacagatatacgtttttaaaactacggattggtccgatggttagtcatattgaattcaccttatggagaagatatatttagcacaaaattttgtatttatgtgtgaaaatcttccagataagtgaaagatacaatatgataagtggaattagttttgggtttagtagactgaaggatacccttgacaatatcaaaaaacatattttaaagtagaaaaaaatgaaaagaatttaaaaaataataaaagtaatgtattttttggtatagactacatgtttaggatttaatatgcatattcagaaattaaacttgagatatctaattaaattgaaataatatcatactagttgatctaagcgctcataataataaacgtgatgtaacttcttcttactttgatgttttattcaaagctaaaaataattttaataattgtcttcatatcatcaataaaatttctccatgtgtttcagctaatgataatgactccctcttagtgtctttctctattgatgaatttagatctacactctttgaaatggattcagataaatacacatgaccaactggtttgaaaccaacctttttaaagaaattttggcatctttgtggatctgagctctttaattctagagtctcatggcttgaaactagccaattcccacctcaggtaaataaaacaacaatttttctcatccctaaaaaatctaatcccaccaccatgaaagatttttgactcatagtcctttgcaatgttatatacaaaattatgtccaaagtcctagccaatggccttaagcttattcttccaaaatgtatctctcctaaacattctgcttttatccaagatcgttccattttggataatgtccttatagtctctgaaattattcaccacataagatgcaaacaaaaaggaaaactatgagaaattgctttcaaaattgatatcagcaaaaaaatttattgagttgactcgaactatctttttggcatcatgggtaagatgggatttaacaaaaaatggataaactgaatgagaatttgtttcccatcaatccaattctaggtggttgttaatggggataatgtgggggaaatttttcgagggagaagacgaaagatagaatgactcactaccatcctacctattcattatttgcactggggtctttcaactattcttaaaacacggggaggtgagaggtgacatacatggtgtgaaggtgtgcaaagggactcccctcccccctctcacttattattgctaatgattgttttcttttttgtcggcctaaaaataatgaaattttcaccctttaggagatcctagacacttatggaaaagtatcaagacaacttatcaattttcaaaagtctgaaatctttttgagttcgattattcaacaacaacaaagacacaaaatctcttcctaggtgtcactaaaagcattggatccaacaaatatttaggacttccttcaatcattggcaagagggaaaagctatttttgggttcatcaaagatcgtctttggaattggctcaatcattggactagtaaacaactctcaaaagcgggtaaagaaatcctatcaaatatgctgctcaatctatacccttttgctgcatgagtgcttttttgctccattccactttaaaagatgattttgaagaaaatgatgaagtgtttttggtggggcaataacaacaaaggaaatgaatcaattggctcagttggataaaattattataaaaaaagaatttggaggaatgaaattaagacacttgtacgcctttaatcttaccatgttaggaaagcaaggttgaaaattcactaccaaccaagatactataatgttcaaaatcttcaacgctaaatatttttcatcaatggatttcttggatgtccaccttgggcacaatcccatttttgtatgatttagtattcacgcttcacaggtaatggtaaagcaaggtgttattggaggattggcaatggtgattctactcatgtctggactcaaccttggctctaacaataatcttaatccttttgtctcaaccaccccaataatggtatctctcctcttaaagtttctgaccttattgatcatgctaattgcctttgaaggaatgatattctagattcaaacttcaaccaagaggatgctcaaaaaattcgttccctaacactattgaatatcacggagagagatcaactaagccggaaatattcaacgaatggtgagtacactgttaagagcgcatatcatgccattatggatcatttgctagacaatagccacctcaaggttaaagggaattggaagaccatttggaatcttgttgtgcctcaaagaataaagcacttcacttgaaggcttcttcgaaaatgcattccaacaagatccaacctgcgcaagaaaaatatcctctatcccttacattgtgtttgctgtgattcaaatattgaaaatgagtggcatctcttccttgcttgtgatcatgccagactcatttggcaagctgctgacttatggaatctcgctgagcatagatgggacaatgcagataatttccatgattttatgtttgattttctataggaaagccatcttttatggccctctctcttgctatgcagcatttggcagaatggaagcatgcccgtgccttgcacaaccaataacgtccacctacaactcataatggcacagcatcataaattcctcctcaccaaagacatatcaaatgtaatttggatgctgccctactcaaggattctcaaacctttggcataggaatgtgcttgcgggattctcagggaaattttatcaaagcaaaatctgctacaattcaagaacatccaaaacctgaagttgcagaggcatgggctctacaccagtccatcaattggataaaaagatctacaactccagaacgtgatttttgagttggattacaagacggtggttgataatttgatcagttgttctacaggaaaatcagacttatttacaaagatgtagagcctccatctcttctatcccaaactcaaactcaagggtgagtgttataaagagacgaggaaatcaagcaactcataacttagcaagagtttctcgattttatgttagctttggtgtcttcaattacatcccaacttgtattgtttctcatgttatgaatgaaatgtaataacctatgaagtaccgataccaacacggacaccggacacggacacgtgaacacctgtaatgttaaaaatatagaacgtagtatgggtgttggacactggcacggacgcgtgtcgaacactagacacgacaagaggttagaatattcatgcttcatagataataactatgtttttcatttaaaaaaaacatgatatataaaatatgataaaaaataaatataggtttgatagtgtcttcagttacatcccaacttgtattatttctcatattatgaatgaaatgcaataactatatttttcattttaaaaaaacatgatatataaatgtgataaaaaaataaatataagtttgatatattttatttttgtcaaactactttcttagtgtacaggataaaacaacagaaaaatacaagaaagtaaaataatagtgagaaataataaaataatggaagatatataatagatcatacaaacatccggtcaaaacaaaaagatgaaacaaaagagagaaaaaaaatgtaataaaataaaagctagaataaaaaaaaagttacatgtatgaatatcaacatcctttggccttaatacgtgtcacaaattttcaatttgattcttacagtaaaaaaattactaaattttatttgccaaaaattatcaatttaattcttatcatcatatgtcaatcaataaccattgatctccttacctattcttaatttagtttttataatatagagcatttctaattgtatcgctatatatatatatatatataaataattgtatcgctataatttattcttaatttggtacccgtaaatagaaaccaaatttagaatacactattcccatataaaatcataaaaaacaattcacacaagtgataaaaatttatgtctcttaattaaataattcaagatttaaatcctaattcaccttttaagtatgaaataaagataaaaatatacaaattttgagtagtctactagtcgtacaaacactaaattatatatttaaacgcaaaaaatgtacaccttatcgttatattatagccttgatttataacaataataattacgtgtcattgtaagtcggtgatgaatgatgatataccatatatgcaacattatacacgtggctattttcgtaaaactccaatccaaataaaaatccgtgttctgaatcagtttctgactcgatcacaaatccgttatttttttaggaaccacaactccgatttatcccataacaataagtaaataataagtaaaatggacatgagttttagcaaaaaaaaatagaaaaactaagcatactaaaacattatcattttaagaaagaaagaaaaaagactatcataactgattaggatcataaaatttcctgaaactccaaatttcttctttgtgcaaaattatcaatataatcctctttgttaaaatcaacagcgttatgggatgcttaattatcaactcaagactcagttaatgacgttaaagccaagaagattcacttccattatgcgggacaacaaatttaatttaacagaagcaacatcatcataactaaaaaaaaaaaaaactaaactgatgagaaagagaatgaaaacaaaactacgacctagaacaaacacaggaccaaacatatatttttcctcactctaaacaatatgcttttaaaacggggcaactgtacgaatgaaattctaccgctagaattctttgattagtaaagtaatccaaatcaaaaccaaaatttaaaacaaatgggacaagcaatgaataaaacctgattacccaagcagaatcttatcaaggaaaagaaatgatgtacctgtaacctgttactggtcattaaaagaatcctcttccattttctttacataagtagaccgtgtcagacattcacaaatttccacatatcagcggttcagcacaagcgtacaactctagccacaatgaattgaatggctattacacaattatcaattaactgcgggtcttcatgaaaaggaccagcttaccaaaacatggggagggccaatgtatatctacttccattcaagtcatcaagtagatgactgatgactctttcaaactcggactcatagtaggcctaatgttttcaactgttgaatatgctcgggtggaagagccgggggagaccaatccgatcctgtcaactctccatcaacatcttcaaccacatactcctatgatgagaagcaataatagtttcacaatcaacaattcaagacgacgtcagaatttttcagggcatcatgatgttctcataaaacatgcagttaacacatgggattatcagtactgataactaatctcaaactgcttgtgttccatgtcaaatgtaatccagaaagaggccgcccaaaagccagccttaaggcatcaaaataccagactcaagtctaagctcaattactatcacacccggataagcgaacgagagttgcaaaatcaaatctaaaacacttgtcatatcagacagacaaaaagactaaggagagagaatacatccaacaaaactcttcaaataagttgatgcagacattgttagcaatgaataaaaaactcagatggtaaacttcactaacaaattgaatgcaactccaaacggtgaagacccatcaaatccaaatctcgaaactgtgggtcaaatcacatcctctccagccaatcttgtctgcagccaaatcataaccgttgattggttattgcacattaattcatgcagagagaaaatattgataaatggtccagattttggctgcacagaacatcctgctgcagaggcaagagaggatcctgatccacagtgacatatctgacaaccgtatggcagcctttctgttacatcagtgcttcctagcaccacagccccaccctagctaaattatacaggcaatggaagagcaggaggggattgcataatgcatactcatgtacttgggatgggtgtgtgagtgaggataaacttgaggaattgatttgtaacacagctgcacatgcagcaggtgggacgaaggagttttgctttgagaacagaatcaggggaagggggagggaggaggaagtgaggcaagcatgtactgagcaagagacagagaagaagaaaagtagacccatcaaagagtctgacatatttctgtatttacttcttttggctgagcttttatacaattaaagatcctcatctatataatggtatcatattcatatcagtagcaaagatgcatattattacgagagtttggaagtactttccacattataattccagttctctgccaaatgtcaataatttattatactagaaaatccttttgaagtcaatcaaaacagctacatcaaaagcaatgcatgttatataatggtaagctagtagctgaaatacatttactttcgcaaaaccatcaggcatcataaaaatcctcagtcaatatggctctaatgcaagagaatctaaaaaacaagtcaattacaaaagcagaaaaaattatggttgagattcttggctattccttccctggtaaatgtttctgtgaagatattatataggacttaaatgctaaaaaaaacccaagtgatggctaaatgggctaattgcatatatcagttaggaatttagcatgacttgacagctgaattgcaacaagaattgacagctcatagcaatgcaccaaaagcacaaaagatgagaaagtaaaccaaccacacctttgttaacatcctttttgcaagtatgtgataatgacgttgccatatccgttgacctaccatggtagcaaccaatacactgtagaatatcccaattacagtaaaaagtcccagaacaatcaaagccataatgaataataatggtagccctgcttccccagcaccccccaaacaaccaccacattcagttgccatggttccacaactctcaaagcatgtggtgcaatcagtccacatacaaagagtgcctggcaaatgacagtctgcacaaactctgcaacaacatacaaaacaaaaatcaaacttagtcacgaatcactgccattctgagtcacaaacttgctgctaatataacctaattcattaataacacgacacagccttctttctctgtttagcataagcaagcatgaataatttaacaacggaatattatgtctttcaaaaaaaagttattaaaagaagggtctgtgatatagtgtaaattaaatctttatctttatatattacactccaagcatagtttctggcatcctacaattaagcaagaaaacaagcattataacgatgcctcatgcagatgctcggagtttcatcatgtgttctgacaatatcagaggcttgtgaatttgtaaaatcaaggttattacccaggttgacagcaacaaagacatagttctctacaaggctgagctaaatcattgcgtactcttcgatcatagcaggtaatgaagcacccagaaaggccaagcaaggcgaaaaacaatagagctcctgcattaaaaaataccaacaaaacatcaacacaaaaaccagtatctttttaaatgtggaacaaggaaactatgaactcaaggtgatggaggaaaaaaagaatttgcagaaaataatgttgtataagcaatttgatgacaccgtttaagctaaacgcaatttaccacatatatagtaaaagctcatttcactatcaaaaccccagagaagacgaagccaatattgctggtaaccatctattagataaaccaaatatgccagtgaagcaatgacctgcatataaaggtaattaaggggataaattggatcacctatatgcattcataaagtaaaaatggataagtagatggaaagattaatggaaacatatcacctacaagctggacagacagaaaaataaacaaaatatctctggtgacaaaaaaccgaaatttcagggtacgccatttcctatcagcggcaacatgaacacgcaaatgataaggagccttgcacgtagtgcagtgagcaaaggcaaacccttcctgcaataaaaaattaagtattatccatatatttcttaggtcaagcaccgcaaagtacatcattttacacattgttatttaatatggaatatccaggtgtttctccatcaatggttatttactcagtaccttacaccccacaatgcaccatatacattagaggattttttttccaaagaaaaattagcttgttgtctacagttcttttcatcactagactaagtcacaacaattcattttaaagataattaattgttacagtatcatactatcattaaaaaaaaaggaagaatagaatggaagactaaagatagttactaaacaaaaatgtgtcaatggcaagagatacaagagcaaggaaaacatgttaaaagccatggagagtaaatcaaaactgcaaacacaaattgcctaaaataaaattgacaaacatgtaaactcttttcatcaccgaatagggtaatgggtagccaagagagagagataactgaagggtaagaatcagcagaaatcatcagaaaggatatgaaatgttaccaagtcaagtacaggctaccaggggtggatcaagagatgtatgaaaggggggccaaattttttttatacaattatttaaatatttaacttaataaatgattatttaataaattatgaatttcacaaaattatttattatcaatttcatgcgtaaaaccagagatatgattcaatacaaaggaaattaagtaaacactaactcaacattctaaattttctttacttttctctattaatatttttttaaaaagaaaattcttctcacatatacaaagagtcttgagggagggagggagggcaatgcccccccttgaatccgttaccacagggtaatagacacaggttagaaaaaatatcatgagatcaacaaatgaaaacataacatagatcatttgattaattgattaaccaaacaaaaggtttaccgaccaccaaaaaatagccttgggtcagttttgcataaaagatacagcttgccatccttactatcaatcacgaatcatcatcacttataaagttgtgttgttatgtaataaatcactaatcattaccttaattgctcgccaatgatccaaacattctcgatgcacatattttgatgtacctttgcacttacaaggggctatgaaatctctacctgggtaaaaaaaaacaaggaagccaactgaaaaaaaatatgatgacacatccaagcgttgaggataaacattcaacaacgaagcttacatagctgcaatacccaacacgtggaacaataacagtcccaatagcaactatacacataattgcaaaagaaaacgcaattcaaattccaatcaaatgatccagacgttatcgaattattcgaatacaataattcatttactttgcaaccaaaaatcagctgagcttgaccaataaccgtgcttcttaacttaacgcgattcaagttgttataaaatgaattgaataaaccgaacaggtaaaattcgaaatcacgacttattttatttagtatatagaattaagaatagattgttctcaccacatcgaagtgcagcttgccctaacctgaaaagtgaaactgaaaaatttaaaaagaaaaagaggatgaaagtgaaattaccgtcagtttcgagacaaattcggcactggatttgttcggagggaccggcttcgaggtcgatctcggaagggtcagcgaggggaaggggaggaacaagaggagaagaatctgagtgatcggccattgaaattcggagggtacaagtgtcaaaatgaattctaattcttcatcatcatcgttagcttagattaaatttagaatagaggagaagaagaatctttcactgatgatccttctctttctctctctagaactgccaattgcgaattgatttttcaagtttttgttatcacagacacaaaagttgcgagactacagtgaaaccggtgaattcccaaaactaaccgcgaataacaatcaaatctgcgttggataataaaatctaatgaaaaaggttaataaaaattaatattttaacaataattgtaatcattctgatttaatcacattcaaaacaactttttatcaatttcaaaagtaaattatataagaattgaatttatttttttaaaaaaaaaattagcgtatattatttagttatatatctaaacattctaacaaattaaccttccgttaattttttaacattttaacaattgttgataaacaaaatttaatttaaaagtattactagcttaattgtagcttttcactcttaattataattttatgaaatttttcattaatttttttttttacttttctgtgcattactacattctgtcttttatttttaaaatttcacgaattttattcatcggtttttgactatttatttgcattagttgactttattaactgctgaggtaaatttcattgaacgacactgatatgctggcgtccaattaaagataaaaatactcgatttttttaaagtaaagaacaaaaggtatgattaagcctttagataatagtaaacgtataggagatagggtttaaattcttaaaaaagactctttcttctcactaccattaaagtaactaaatcattcggtttgcttgatttatagataaaaaaatttatatataatattaatttttattattctaatttaaaaaataaaaatttatataaatattaataaaacaaaaataataaaaataatgtcacaattagacatagaagttgttatggaagttctttattgaagcttcaacttgaattctcattataatctccaatacaaaatactcaattgtcctaataaaaattttaaacaacttttagattaagagaaattgagaaaatttactaaaaaaaactgataaaaataactaaaaataagtagtattttttaagtaaaaaaaaaaacttaaattaacatttggatcactaaaattatcaataactaaggtgaaacaaataaaaatacatcaaaaatattacattgatatgtgtatggtcaaaataatttgtttttctaatcacgatattggcatgaaataattcttataaaaaataatgattaatctttgttggaaaggcaataaatacatataagataagaaaaaaatttaatataatttatttcatacccaaaatcataattattttattatatagtaaatatacacccatagacaataagtacccaaaaataaaagtagacataggcaataagtaaatttaaaaagccagtactccacgagtttttttttttgttttttttaccggaaaaccgaaccaaaatatcccccaaactaaactacaaatattatcggttagtaaaactgtaaacgtgccaagattgtatctttttggtagtttttgtagcatttacttccaaggaatgaagaaaagattattcgtagagattttgggcttcggccatcaattcaagtttttgggctcattaccagtccatttatcatacctttccaaggagggaacaattattgttattgacactatgctaatagcaattttatcattctacattcctttctttttcctacatcctcaacccttcttccttcctctctcactttccccttcttatttcataatacaccctacccttctcccttcctctctcacttcttatttcttcattactttttccaactcttgtcttcactctcgtctccctcacatcacctaatgttgtatttttttttaatacaacagaatcgtgtttttgttgtgttttttacacaatgaaaacatgcatgatttgctttttttttattttttagaattgtaaattttttaattgttctaaaatatacatattgtatagcaagtcatttaatgaggtccttaacaagtgaataatgagacaaaacataacaatggaaattatttttcgacaaaaaaattataaaacagaaacatgtttctatcgtgcatgtatataatagaaacatgtttccattttatgaagtgcatcagataaaaatataacaacaaaaacatattttcattgtacattaatagttatacaatggacgcatgttttcatagcgcaattgggggtggcaaataaaaaaacacaacataaacatgtttacattgtgtaactatcaatatacaatgaaagtatgttaccattatgcatatggggataaaaaaatttaacaacgaaatcataattccattgttaaattttttttaatcccatttgcaaaacaaaaccatgtttctattttggtttatgtcagggggcaattttgggataccataaaaaggtactcacactggtagtgccaataacaaaagtaggcagtgataatagcaattccctttaaaagaaagcatggatgtgatggaactctatttagtattggggctgctattctcacccgcaattttgcaaaattacttgcctgcccctcctccctttcctgcaccccaccatctttccttcttccttggttgcacttgaatctgcgattaggtaggttttttttttcttcatacttttaactgaactgagttataattttgttgtatttccaacacaacagaatcatagaattttttatttataaaaaaacaacaaaattataattctgttagcgtgtgtctgggttgagatagtaacttaattcgagagattattattcacgcttatcgtgatatgatgccatcacgtcatatatcattcaaacttatatcacgtcgtcattattgttttcaattaatcatgtgccaataatgctcaatttaaaatttatttatttaacgtaaaaaaatggcaaaaaataattatacacagaaagaaaattaagttactctaagataatctattgataacattactacttttaataattatttttcaatattaattttattattttaaccattaaattaaggtttaaatatttttttagttcttattatttaatgttttttttagtcttaaaaaattatatttattttatttttagtacttataatattttaaataatattttgaacagtaaaaaaatattataaaatatcatatgaatcaaaaataaaataaacataattaataaggactaaaaataaaaaaaaaatataataataaaaagaaaaaaagtactaaattacagcactaaagaaatattaaatcttaaattaaagttgggttgaaaattcattaaattaaagttaatttttagcaaataaaatatacatttttatttaaaactaaatttatttaatacttcatttgaccaatttaatataatataatttaaagtatgtttctcttcattataaaattagaaaagtttgatttttgacccaacgaaacttgttgtatgttttcaattcttctaaaattaaaatcttataatatgtttcaaagttaaggttgattaaaattgaacatatatgtttaatgaatataagttcaattttacacgtatttagtccttaagtggagattcatggtatatgtatgtgcattttaaataattgaccttaactctagatcaaattatgatatattttaattttacaaggattaaaaacataaaaaaatagtatggacaaaaatcaaactcttttaattttataaagatgaaaaatatattttactttataatatgtatatatatatatatataatagtttttttaagaaaagtataataaatattaactataagtttttataattattaagctaatgttaatatattcaagaattcaaataattaatattttacatatattggctaaaaaaaattacatatataattgattgcatagttaaaatgagtaattgatccaaaaccgatcaaaacctttgattataaaggggaaaaaaaaccttgttgatgttgatagggaaacttctcagttctcattgtcaatcagaacttgcaagttgcatttccacaaactgagttgataatttttgctttcaactttaatccggccagtttcgtgaccgtgtttgaggagcacagcaacaccaaacatacttgcctttgaggtctttaccctcaagccaatgatagtaactccaaagtcaaaaagttcagtattttttttttttttcattttttcgtcagcttgaatgacacttggatttagacaaaggttttttcataataattataataataataattttcacgtaaggttgagcataggacgagttaattcaaacaattttatgtcattatttgacctgaaattttaataaacctatttatttgagtcaaaaccatccaactacttgccttgcaccccaataaaaatgagaaaaaaaatttactaagaaaaaggtgaggaaaaagtatcagaaatcataattaaataacaaaaaaaagtatattaacaaaaaaagtataagaattttatccttgaggtttgaatattttttctaggtgttttcatactttcaaatcatcttgtaagaatctttgcatgacttcaggttaaaataatatagtattaataaaaaaaagtataagaattttatcctttttgaaacaattaacttgatccaacttaaattaattgaagtataaaatacttttaaatacggttcatcttttatttaaagtaaaagataacgtataagactcaacgtgttgtcaactaaccaatgtttttttcttttacaaaataaaatgttcaagttatcgtatcatatcaaatcaggaaagataaaaggctcacaatggattaacataaaaagaaggggacaagagataaggtggggttgtattgaaacccttgcgcatgtgagaaattacccattgaggcaaccatataatcagtaagtgaactgttatttatggagaaaaaaagtagagtaattgcttatagtgtcttaatatttcgaaacgtgtcatgtagagtaattgttataaatttttataattaaaaaaaatgttttattggttataaaaccaaacaaaaaatgattccattaaactgtattattatttttgtattagataaatgattattctccctaaaaacattaaatgctctttattaatattttttcatttaaaataaataaataatctcaacaagttatagttattctaattaatttaccaataaatcaaatgaaattatatagatattttaatatttatccaattataaatataattatttttttatagatcacaattattttttcaccctttgagtattcgatatacagttacatactcgagatttgaattagaaattactaattaagttaaactaattttgatgtagttgatttatgcactcgattgtacaaatataattgtttttaaatattgtgcaaatgggttttggggatttcacttacttaatatgatttagaaacattattattattatttctgtaaaaaaaaagaaatattattattattacaatttcttcatccttcttatatacttttttaaaaacgaaaaaaaaaaatattgagtttcgtttatgattaagaaaaatgtttcataattaaaaattaaaaactagtgtctgcatcatcacattactaaactaggttgcctgatgtcactactgataaaatcaaaggaagattcactgacgcaagaggaagtcatcatagaagcagctataaaaacacattttagtttccagcatgcaaaacttttgattacgcgagacatatctccatttataagtgtcttgaacaaattatgaaagtagttagcaacttagcatcctcttcttctttttttctttcttaatatgcaatgttgatgtcccttactttcctttttcttgtttttcaaaatacacaacttggggttgctactgtttgggaagctagagggagtttggcaggaaaaaatattttaatttttcagaaacttggaaaacttaaatagtatttgatttgagtgtcttttttgttttcattttcaaagaaaacataaaataacatgttttgtttaaaatttagaaaatattttcaaaaacatgaccaattgaagacaataaattagtgctttcagtttttcctgaaggggtgaaaatatgatggtatcttggaatatataaaattaaaaaataaacattcaaatcaaatgttatcttaattttctgtttggtatgtattttttaaaaataacattcttgagaaatgatatttctaaaaaaaaatttaataaattttccataaaaactttttcgtgaaaagaggaggtaattttactttttttattttaatttttactacagtaaatatatcatatttttttattaaattatataatatgataaataattaaaataatcgataaaaatatacataattatttaattttaaaaaaaattatttaaaaattttgaatggtcagaaaaaaaattatttattaacatgaaatatgagcatgaagattcattatttccaaaattaaaaaaaaaaaaaaaactcctacaataccaatcgtcggttaaattcttccatagcttgagaggccccaatagccattcttagtgacaacccactttggattgtcatttggaataaaaccagcaataggaaaagccaattgggtgtgtttgcttgacgtatcacttgccattattaattattcaaaccaacacaaaatagggaatatgaaaaagaaaatcactcttgtgtcaaccgaccattccaaatgcacccaccaccatcattgtagctttatacacatcattgacaccgagacctaatagcctgtaattatttaaacttatccaatctttttttaaaactatttcttaaatgtcttctttcctcaagcacataatccaatccatatccaattttatctattgcttatcgttttggccttttttcttttacaattacaacaatttcgccttttttcttattagccttacgcagttggtgacgccattgtaccttgcaatcgcacgaggtgaaggtgtcccaatgtccctcacaagtacaatggtcgccccttatgcttcattcgttgtctgtgccttttccgatacacgtatggttccttcctagcaaatattttatggattaaataaaggataatgttcttgtaactaagtcgaatctaaggtttaacaaatttaatccaataacatttaattgagataatcataatttgtcttttcagttatatttttgggattcttatgaatatgatctcctctttaattttataatgattgtctttatttttatctctcaattaatccttaatatgagtgttttataatgacttttgaacgattttatagtttcggaaaatattatatacaaaaataatttatcattattaataaggaattgattaaaattggttgacagagattaaatcatgggagaaaaatcttaaaagagttgacaaaaaaataatgcaaaacatagtccttcagtcttagtgcacaatgagatttgaagtcatgtaacgatcaacaaataacaagaataatataatcaatcatgtaaaataataataataataatagaaatcaagaacaagtatgtccaaaaaatttagggagggtaatcgaagattcctgactcaatgtaggccatattgtctaaagagtgcttccaaatttccattgaaattaaagctcctttttaggcacctagacctcctaaagggtagtgtaggtggctcggatcttcactccaccttgttaaattttctttgtgggatctcaacgtacacattcaaagtgattgacaagttttttcttccagaattttagtaattgtcaaaacaatattgttggtctgataggtcctcaaataaatggaccagagaaatttttatttgaatcataataggtaaatttaaaataatctattaatttatttagtatctgttaaaaaattattaaaaaagtttaatctatccataatttatttcataaaaaatataatccattcattagcattttttacggatatatattcagcatatccataattttattttaaaaaattaaatattatttgtataaattttttgtttaattcactttaaagaagccattatttatttattttttaagataattttttaaaaataaatatttatttcttaaatttaatatattttcattaatatataagaagatattgtatttttttaaaaaaaaggaatccaaatatgaaaaaatatgttggatagctttttatctgtaaatagcttattagatggtccatgagatttgaaaataaaagagtataaattgttattcatcctttcaattatatgaaccattcaataatgaaggctacgttgggagagttaatcataacttctaccatgggaatgtttttcttgtttgcaagatatcatggttttaaaatcataacttaaagtgtaagaaattaaaagagtctaagtgagaagaaaaatgtaggaagaaatagattacaataatatggataagtttaatttggattagaaaagtaagggagaaagagactgcataaatgtaaaagatttaagtttggagaaaaaaaatagggagaaagaaaccacaaaaatgtaaaaagatttgagtttagaaaagaagatattggaaaaatgtaaatggttggaaaataaagtgttaaaatcgcaaatacaagaatgtaaaagacattaatgataaaaaaaataattaaagtattgaaataacaaaaaaattaattaacaaactaacaattaatatttatcaataaaaatattaaaataaaaatgttaaaattgaaaaaaattaattattatgtagtgacaatataaaataatttctcactgtcatacaatcataattcatgatttgtatgactttaagataattttgttaaaattaataaacttatgataaataataatctataattggataataatataaaattattttaaatagttattgcataatttttttttacaattaatatggttgaaaacattgtaacaacctgtcaatatgagaacattagaaacttaggatatgtaagatatttacaattcacaatccttattacatgatgcaaactagtatttttagacagctattcctaactataaataacactatagacttatttcaataactttcaaactcggtccaatcagtaattcgatttaagtagtgggttactggtccaatgaactagtaattgacttaatatatatcaaaaaatttaaaattatatatgtatttattatatataactatataactaacattatttgattaagaaaaaatcatttatacttcaaaataataattgaagtattaaagttgataacaagtccacaaataataatttaataacacaattacacaagtttcagatttttttagagcatttttgattttttatacacgaaacaggttttaaaaataaaatcggctcgtcgggtttaccccaaatcggtctggtctgaccggatcatccgagaccagatgtatgaccggtccaataactaaatcaatccaatccaaatcgagacaaactggatttttgaaatatggtttgaagtgtatttaaaattttatatacttttttatatctatcatgttatagatataaaatattgataagttttattaataattaattattataaaaaaatgatggtctatcaatcacaattttttttttcatttacagaagttaaacttgagatttaatttaagaaatctaagtttaattttactcaatctaatcacatgttagtaaaattttatacagagtctaataattatagataaattagaattttaaaatatacacaattaattgccaataaaatatctatttttcttctcaagaaaattacgagcatgtttggatatttgttcaaaataggatacacaaatttcaagataaatttaatgattcagaaactttattttgcaaaatgaaggatttgagtactttcgtaaacctcattttagcctaaaagtctgtttgaacaataaaacaaacatttactaccttattattgcctttccttaagtagcaagttattaattcctttattttgcaagtgaatacgtttcatattgcatgttttgacttggactaatggacttctccatattgaccaaactcttaaaaacaatctcgattgtcttcttgcgaaattgatttccatcgatttctctctattttttcttttctaaattatattgacaactatatatatatatatatatatatatatattatgtaacaaattttatgatgcagttagataacaagaatcaaacaataaaaatatataaaaataagcttaagtaattaatatccctaaaattaaatcagataaattaaaatggtttgtatattgcttgattgttgacttgttggaaaaaaatttaaagtgtgattggctctcctatcttgtcactaggaaaaattaagcaacaaagagaacaagtaaaagaaaatgggcaaagaaaaaagtgtgaattgttagttggggaatgttgggctgttcggctagaacagatattgctagaacaaaaaagagtaccaaagtagatttggattccgaagttaggaaagaagggttattttaaagtggcaggtaaatgtaaacttccaataaattaaaggaaagggaaagaaccttactatggaaatgtctcaccgtgacattgtatgtatttggatgaaccttcataaaattaattctaaaagaattgattttataaaattaattttgaagtgagatagtttgtgtttaaatgttttattataaaatcaagttaaaaataaaattcagtacaaaaattttatatcaaaaatagaagttgttgaaagttactttaacaaaaaatcaattatacgtttcaaacataaaattaaacatctatgtatctaaaatcaattttgtattcagaatcaattttccaaagttaaatcaaacatgcactattttttttagacgttattatataaatctatataaccttctgggagtagtttaaacaaatctaatctggaccaaacaaggactcaaattatcttccgggtgtgaagcagtacttcatatcatcaaacaaatgatagacatcgcatttcctttacttttattattagtaagaatttctattggcactttttcccttttcacctctttttaagataaagtttgtaaaagattgttcaaaccaaaatcataatgaaaacttctgtgggtgtgggtctacaatcctgcaaattcacggaagcaacaacatttttatcactttcaactataatatttgcatatataagggcattttcgcattacccaaatttctttccttttttgttgttgttttggttttggtttacgtttggttaatacaagtatagtatacacccgatggatcttgcacaaaaaaataggaagtcatatcccataagaagggaactgaaaaatgtgtgatgatcgtcaaactcgccccaacatcatctgaaaggccaatatgtgacacaaaataggtctgtggtttgtggtgattgctaattaaaatatcaaaccagaagacaaaagggacaaagaatgacatgtagataacaacttagcgagtcagttttgaacccttttgtctcaatggcgctgcatagcgtagcattaattaatgtggattttaatatatcctacacgcaacatcgatcatatagattctaactggtttgggtatctttacatgatttttttgcgaaataagattatgcaaacaaatatagatggagaagtactatatattgtataagaaaatatttatgagggaagtgtaaggatgtttccatgaaaaaaagaagatgtgggcctgacacaaactcttcatttcttatatgattatgtcatttaaaaagaatataaaatatcatattacatttattaacaaatattttaacacatattaaaagtggaaggattggttgagagggtttttcttatttataataagtatcatttttatactaaaatgttcttttttttttttttgcgtgtgctttagtcaagctctctctctctctcaaatttcataaaatttgtgaattagtcaatttcgttttaattattatattgcccttttcaatttcttataaattcattacattgcatgtaatttatgtaaatatttaaatacaataataaacttaattgtataaaaagtaattgtaaatttgtatacttacatgcaaagaatgtattaaataattaatgcgaatttaattagtattagaatgataactggatttgagcgtaatggatacgcaatataattacttatacgtaagctttttatttaatgttataggtacggaactgtagtatagcactcatccagcatctatattagcccctatacacatataataaatataattatagaattaactatttattatatttataattagtttaaaaatattttagatatttttaaataaaataaaacattttacttttaatttttttcagttcataaaaataatttaaatgtaaaaaacatttttattttaataatttataaaaaaaagacacatcgaaaagaaaatatattacatgaataaaatactaataatatgtttggatacatacccatttgagtataatataagtatggatttgttttggaaggctgaatgctaaagttaacattgctttacgcatagatatgaagttagataaatatttttcttgattgcggatattcgaatggatacattacacaaatggctagccttactaatgatttgacatattattattaagcagtaccattttctactacattttaattactgaaagaatgataaatgttgtaagatatcaataaacattgacgtaaaaaaacaatacgcatttaatattatgcttagggtgcacaccatttaactaatctcgttagatacttgcttagtgctttagatgctttgatttattaggcacaaatgcttttggaatttggtatatttatcgtggaggtcaggtcaatggttattaaagtggagagggatgcatcgaatcactagcctagtagcccaatagaagtaatcggcatttcgaaggtctccattaatattccaattccttagcctatcaaacatctaatctaacatagagacgtaaggatctgccaattctgatcataacaatcaacgcaagtattcgatttcaataataataataataataataataataagatgggaatgcataggtacaaatgttcgtattaatttgttaactaataatttaaatggcatgaaaagcaatgcataaaaccagccaaatgttaggctgtgtgtataatgtaagacacgaaaaaaatattgaaatgattaggttttgtccaatctcgtgtgaaggtatgacgtccccttctactctaaacactccacaccaccctcacttaatcatataaaactcataatttcttgactttctaatattgttggtggtgccgtgttagtgcccgcattctatttaagttatcatttgtaagtaatttcgtggatggtgacaccaataataacttatactaacaactaattaagaactatagattaccacaaataattaaataaataaaaacgaccatgaaatattaaatgatggtatgctacattattacacataatatataatactatatgatataaatgtagccttgtcaacatgtgaggtgagtgtgagtgtggtaaatctttagtactatttgattcttacaaataaacaaaatgtaacaatgccggcgttgatatattccggtggcgttgagacagtgaagggaacagtgacagagtcgtggtctacctggtgcgcacattagccatagtggaaacatgacgatgactgcgacacttggtatgtgaaatatatttgactctctgtagctcaacacgaccaagcatttaacaacaaaaaaacaagttccactctccaataacaagacacaaaagtctcctctattctaatacgtttttatttttttatttctatgtatttgtatatacataaataaataatgtaaccccatttacaaatggtgggctacgtttccattttttattatataataaaaattgaagttagaggcagtctttgaaagcgtcgtcttctgaaccaacacaatgatggaatggaagggtcttgcgttcttctgcggtttgatagatagctagccatgttggcatgaagatttgagcgggaaaataataagacaacatacataacgttttctcaaagtggtttttttattttattttttttatcataaggtttggctttttagttttttatttttcagtttttgtggataattctattaactgtcaagggaggaaattggtacagatcaaagtttggttgtactttgccaactaaatattatgacatcaatagatacttagatagatagatgcctttatttatctttgttttgaactactatgattactggtactttcttctggcagttgttacttaaaacttttgttgtctttggaaaaagggaacaaaaaaaggtaaaagggggtgctatttaggatttggttttgtgttcctatgtttgcgaaaaatgatgaggtggttttgttgccctattaatgggaaaatcgtactatagattctgttgcataggcgttgtctgtggcggttgtcatacaaacgtggtcggggtggaggaagaaactaaaacatggtttaattaaatgaattattcgtttattttgtgcttctctttggcttgtgatgtctggtttttttcttgagatttaggttctgtttgtttatcgtggattgttagatattaactaaggaatttcactcttcgtctctctcatagtacttcttctggtgccaagaaggttggaacagtagcaattacttgatctactctgttacctttttctgtctttgcttcttgctcctgccacccttctattcttagtttctctctcttatttttccctttagttgtttctgttattaatttttgaagtgaatgtgtttggcttgcaatcttcaatgcattttaagattgattgagctttaattcatctttttttgggttttgccagacggcagtttgcctgcactgatcagttcttagagcatgaattcagcatccccgcagtttgtttcctcaagaaggatgagtgtgtacgatccgatccaccagattagtatgtggggagaaggcttcaaaagtaatggaaatttaagtgcagccatgcctctaattgatgagacagacatgaagtttgatagtcaggtgcaagtctatgaaatccgtgctttgtttcattggcaaataaaaatgcctattctgcctactaaccaaattcgtttgtgctgtttaatacccagtcagaggatgcttctcatggtatactgggagagcctaataagtatgaccaagaagctaacaaacctactgataaggtaagagcatgttatgcaaactcgtttcctcttgctctatctcttccccaaacaaaagaaaagaaagaaggcttatttcttggtagtgttttgttaattacaacaacatatatttctttaccactgagagcggatgtaaattttgtctcatacccacatggtttctaatactttctgtcagtgggttttccctgacttccattagaaaaaaaaaactatatatacttgggaactcttgaatgcttcctgcaactgaattgtcagctcaacttacctgtaaatgtagatatagataattttgagcattacaatttcttgtttctttcattggggcatttgtctggcatcaaaatgttttttttttcattaaatatgttgtcattttgaagcttcaagtcttattctgtagggtgttgttgtataatgtaacgaagtaatcaatccatttagaattatggacagagttattatttggaatgttttggcatggaaaatcacagccttttcacttttctttcccctccatcttgagctttatgtatacaattagggtgacaatgacaagtatgttagtcctgccattttggactttgaggaatctgtatttaatttggatgtatggcttggattcatactctcttttatgcctatatatggtggaaacaattagggatctaatatggtcaaacatgcagatacaaagacgtcttgcacaaaatcgagaggctgctcgtaagagtcggttgaggaaaaaggtttgaatgaatatacgttgatacattgtcagacatgcaattagtgtttagatatactaatgttcatgtggttgctgatattggcttacaggcctatgtgcagcagttagaatcaagtcgtttgaagttgatgcagttggagcaagagcttgaacgtgcaagacagcaggtatggagaagatgagttaatatactagcagtttctcttgtggatcacattatgttgatcagcatcttccttcctttccctctctctttaatatcttaaggcaacaaaactgcagggaatttatataggcggtgggttggattctaatcatctgggttttgctggatcagtaaattcaggttggtttgttattatgctactgctgctatatatttgcattgcacttggagtttttgtgtcttgttattccatgtcttggtaacttgatgttttcgttttttaaaattttcttctgtggtgaaatcagtttttccaaatgtgcttaaatctcttactattggacatctgaagactaaagtcttctttgtgtctgccatctcaaaatattcagaaacattttctctagtcctgtgccaaccttttggtttcaaatcataatcagttttgtaatagaatccattatttttcttccaaatatccagaaagcggcagaatgtttaaagccttgatatatgccagttggagaattatttatatgtatctttcatgatacccgctgccaagctagattatcaggtctcatacattaaaattgctattccttttctttgttggatgttgtacaaaaccataattaaactgttggtaagttgagaaaatattgtgtaccataaacatatcttgatagtgtcttatattagcccccagaaacaacttttgggaatcttattggcaacacaagtattgaattgtttagaatttttcatggtgccatgtaagcttaagttagtttgttttgattgatgtaatattgttcttggttttccatgagtatcttttcttcttgtgttatactctattttccaatttgttcttgcattataataataccatatttgcaggaattacaacctttgagatggagtatggacattgggtgaatgagcaaaatagacaaatcacagaactgagaaatgctttaaatgctcatattggtgacgtagagctcaggattttagtagatggtatgatgagccactatgccgaaatgtttcgcatgaaatctgctgctgcaaaagcagatgtcttctatgttatgtccggcatgtggaaaacaacagctgaaagatttttcctatggattggaggctttcgcccctctgagcttctaaaggtgatgcctcatatttaataaacgaaagtagttaaaaatgttattcatagaaatgtagaatgtgtagatctaaattcagtcattgtctttgaggactttctcattattattggattttaatcaataacttcttctactgtcttcttgagagagagagatgggggaaatttgaaactgcattcatttattacagttttaatacattatgcaagatttactcaaatgctttttgtacttaaaatggctatcactcagtgtcagtgatagtcccagagagctgggtccagcaagaggtgatattttagatttagtcttgacttcttgctttggtaaagaattgcatcctcacacctgaatttcaaattttaaaaaagggatttattgagatactagattaatttgagattatttctattgccatattcaactatggcatgctgtacgcttgtaatgtagtatggtgcttgctgacaactttattttaagtgcaggttcttggccccctgattgaacccctgacggagcaacaacgtttggatatctataaccttggacaatcatgtcaacaagcagaagatgccctttcacaaggtatggacaaactccggcaaacacttgctgatagtgtagcagctgggcagttcatggaaggaacatatattccacagatgacttctgcaatggacaagttgaaagctctggtgagctttgtgaaccaggtagatatcctgttttcttgatagacattagttctcaatttagtaaaaaattccttttcacaacttgccatatcaatcaatggattcctcctgccagttgcaatttttatccagatgttctgtgaaaaaaaatcatgtatgtgttctggtaaatatactttctaatccacatgtgcttatttgtgtgtctgtctctctgtctctactcactatagattcaaaatagaaaagcaacagtttagtgtgctttaaatatcatgattctatgtcatatgaaataggaacagatgtttggttattttaaatgtatagttttttgggttaagggtattgttgaagttatttgaagctattgatcttgtaagtcaacaaatttttcatatctaaagtagttcttatacatcattctataaattgttttgtagtgcaattgattttaaatttactttttggatgtgtaaaacccataatttgatttgaagtagatgaaaaatatttcataaaataaattccattcctaaattcttagcacagatactgaaactgaaatatttttcattctaaagaatcctcagtagaaatggaaaacaacaatttaatcaatcaattcaaagttttaaaacataattagtggtttatgatctattttaagcatcctcttacgatttgggggcaagtcattgccgtaggcatttaatttcatctattatattagctgtgacttgtggttcacttcaaaacctttacccattcatcttggtcactgatagtgcttgctagccagatttttatttagcgttaccaacttcccatttagcatttaggtagattcacttaggatgcctatatcgtgtaaatgctaaggtcataaagtacagtgatggttaatgaatgatacattaacagaatcatttttgaagatcattaactgctatatacactacaaatttacaacttcaaaaagttatagcttggctaatgactattagagatttaaccatgctctgtgtgaaacaggctgatcatcttcggcaggaaactttgcagcaaatgtctcgaatacttacaatccgtcaggcagctcgatgcttgcttgctttgggggaatatttccaacgcctgagggctttgagctcactgtggtctaatagacctcgtgaacctgcttagtctcacaacaaggttacaagagcgcaaactcataacatgaacgtgatgtgatgatgaatatgggtcagtttctttggccaagagcatcaaaaccatgtatcatgtgaggtccaggttgctcacatttttcctgcagttttgcgttatggagaagttgtaaatatgactgctagctcattttatgcatacgagtttgtaaataaattaattttagacgcatggtgtatatcggattgttgcaaaaatgaaatatttagaatctgccatgagtctgtgtggaagttggttgtgtagaattcgtataatgttatgttgtgtgtttttgaaaatgaatcgactctagactctcttagtggacataatttattttttgtgattgctaagggtagcttgttaaaaatctgtaagttgttattagtttgttagaaagttgttaactctaataagctctataaatagagcattcgtagtcttattgtatcttttattcaatcaactgcaacatgattttatatgatactcttcttctctactctgatctttatggtgtatggccacaatatgttggtgttacttgtctctttcctcgaagttctgatagtgatagtgctcaacaatatttatcataaatttcatttttcttggatggatacttgagattctgtcctagatgctgagtgagaaaatattaatgtgctgaaggttttacgttttcatttgcttttctatatatatacttatattggtaaaccaaacatacacaccaatccacttattcacattcaatttatattgtcaattgtttacaggattttcactatgcaatgggatgtgcagctatcaggatttgtttccttatagcaaattggtttgatgatccacttgtagctagcaggatatataatcatcttgattccagacagaatctcacaacttagatatagcacagtccaaagcatctacaaaaaatctgcacatcaggaagccagtcagtgaacttcaacaaagaatctgaactccacaacttggttgaagagagccaggacagaattatttatatacctgcatcatctttggtgaaacacattggtggcttgatcctaaaaacatttccatgcagccctcctttcccaactagaataccgagctctaaaatttataggagtaaacagttaccatgttttgtagaaattttggaaaagaaagcttcatatgcaattttttttattcaaccaaatttcttaccgctgaatctttcatgcaaagctgttgtttcagcttttgcaggtggcttctattttctatcggtgacaaattctatccccaccattaagcctcttcctcttacatctccaatgactggccaaatatataaaaataatcaacaaattgtggcaaatgtatgctctctataatgaagcatcatatagatacctaagaaaaggcaaatgtatcgtaaaataaaaatatatcacaaaatgaaaacatgaatatttctgggatataagattcaagataaccatactgtcatgtacttgcatcatagatcttaaacgctgaatcgagtgagaaccaacatcagcacaatgacattgacgcctctccttgtcaagaactctgagcacagcaagtcccccagcaaaacatacagggttctctccaaaagtattaaattgaagcttctgggccatcacgcttgctatttctggagttgtaactacagctgctaatggcaaaccattgccaataccctgatgcatgttaacatgaggtacaaatcatacaatggaattctagaaaaggtacatgagaggcacttcaacaaaattggccctatctgaaggtaatgctagaacaaaatacatagtatagtgaaggaaggcaaacaaaaaaaaggaagctaaaaccgataaaaggataaacattgaagttatgcttaagagttatacagtgagagtgcaacaagtgagaagaattcatttaatattcaactatataatgtttaagattgctttacttaaacctatatttataattgtatcatcaaattagttcatctaatgggaacatgctctcatcgtacatgcttcctatatgcataaataataatgaacctcacaacagactgatgctgcacttcaagtgcattattaaggtgccattgtatcctgcaactagttaaaacttagaaagaagagatgagggtctagacctttgccatggtaactatatcaggaatgacaccctgtgtctcaaatccccaaaaatggcttcctgtgcgcgcaaacccacattgcacttcatcagctatgcagactcctccagctttgtgtataatgtcataggctagtttaaggtacccgggtgccagttcaactgctcctcctgtccctagaagaagccatgacatgaggaaaaagtacaaaggaaaaccacactatggtgtggctataaatattaaataccactctgaagtttagaaattaaacatgaaggatggattatgcatgcctgaatagtttcagccataaatccagcaactcttcctgaagggccatagtcaatatgatcttgcaattctctggcgtacctattggcatctgagccaaaaactccgcggtatggatcaggattcatgacatgatgaacttctcccttaaagagttaaatgttgtaaaaaaaaaatacaattagcacttccctatctttagtaaaaagttaattcatcgttcacaatgatatcgttacaactagagtagcatggattatgttacaatgatatagtacatgtttgtgtatgtttttggatacatatatgcacgtgtttgtgtgtgtggacaaaacctctggtattgggtatttctacgtgttcatagccgtgcgtccaattgtactagaactctctccatgatatgcattccttaaggaaatcatacccatattaccagtgtataaacgggccatcagcatcgccaagtcatttgcctctgaaccagaatttaaaaaataaacaacctgtaatataaattgcttagttgaacaccatgttccatattgaatgaatgaaatctagcacactataaaactgaacattgcttttcagcaatctcaaatttggcatgtcacagttttacacactgtcatataatcacaaattgattatttgaattattctaaaataattattttaaaagtcaacaaacttaccatatatgatgaattatgattgaatgtctaagtaaaattttttagtgttagtgtttaacctatttctcttacattatttatcattcttcatagcattaaattggcagagggtttattaaaatttgtaaatatttatgtaaagagaaatagatataaaatattacaaaattttcatgggactagatcatgtgaaaaattaatgtaggaggatcattcccttgtttggatatgctaactgaaacacaaattatgatgataaaattgaccttaaggtttccaggcattttggatgccaaggcctcggcaaaatcagctattgcatggtgtagatatatggttgttgtatgctgcaagagtttactttgctccattatagcattcaaaactgcaggatggcaatgtccacaagaaatagtaactattccagcaaaagcatcaagataacgcctgccattctcatcaaatagatgttgcatcatgccctctacaatgttaagctatataaacaaaaaaaattgttaaaaattacaaaaatatgtggcactcttttcatatttaataaattttatttataattttgtaattctcaataaattttaatggagtgtcagacaaaatatattaaagaagatgtgagctataactcctccttacttatcggtatcgatgatgggattaacatatgacagttcttgtggagacccattttcaaataacgtaactatttttacttcatttctttgactcaattttcagagaaaataaaactaagaaaacatagagaaaaggttagcaacttatcataatatagtaactgataaaagattgattaatttgggagactcacaagtttttgatagaagtggaacaaggaaggaccaaggaactttttccgtttggcaaaaacttcatcagccaaaggtcctttgtatggtcgtggcttgtaatcaaatggtggaagctgaagcctccgagcaatatcatgatcacttgttgcagttgaagtgctcaaacaagaagaagaaccaaaaagcctcttacaaacaccaatgcttctcttcaccatcgccatgtctaaaccaccttttactaaacactacctatacctttatctcaaactcgatcatccattttgtaatgctttgcatgccatgtctcacgaataattgacatggaatcttgttaatttggattatctaacattcaaaatatattatgcggtaattcattttattcaagtaatgtaataaatgataatataaagtttaatttttcaagtcatctattagatatatattgctttccatgattgagctagagcaaaaaagaaaaaagtagactgaataatgtggttttattgccttttattccccacttgtttgcttggtgtaattacaccgtccatcatcgcattttataatgaaaagaacttaaatacgatagtatatgatcatatatatcatataatgagtataagtgcaattgaaattgatcgcccaactacaaccatcgtcctgatcatggcagacatataaatgtacatcgattgagtcaccaagagataaatcctcttttattttgattgagtttataggaattaatcatttattacttctatttgtgtaatacccactccagtataaagtaattcagaccttcatcatttttcatgtaatttgattggtgtaggaagctttcaagggaagaagagagagcaaagtgatggaattaactactggaataggaaagtgtgtacatcaagcaagctatgcacgtacagcaaaactacatgaaaacaagaggggtagttgtagagacttgagataaccagaagaaaattgtgtagatttttcattcccattatttaatttcaatacaattagcatttagcagtacgagaatcatgtaaaggaaaacttgaatagacgagaacaagcagggtagtagttgtacttgtagatacttgagataaccagaagccaaattgtgtagattttttatccccattaataaaatacagcaagcagtataagaatcatgcaaaggagaaaacttgcatagatgagatgaagatatcacaacatcaatgaattatctcaaaagcctgcaggaaaaccaccctttcttgggtcactcactgccacaagctttccatttccaatccctttattttgtctggacggcacagaattgtctagaacaataaattggcaaatagtcccaccggcaaggccctttaggacatgacccttacttttaagggcttccctgatatcagcaggaagttcaaagtgttcacctaaagtggtccaattctcataattaaccacgttaggtagtagctgcataaaacaacatggcgagtttctaaattaattagtgatggacaagttgagataagtatgcagtcacaatcacaaaagagaaaaatatcagaataacagtagcaacataaagacaaaattcttattacttaaaatgaaccaggagaaacagtttctggggacaaaaatatggattcaagttagaagttttaaattctgataagttataacatttttccttggttttaatgctgtcattcattatatatctataactgtctctgtgtttggaagtatttattacagtttatcttgtgacataagtatttgtgcaagtatttgggaaaacttatcaaaatagcgtatgattttgtctataagttgtttttagcttaattcaatttgttctctagtataatttatgaaaacaatttacaacttgtgaaaacagtttaatcatatttcctcttgaattatagaaacaacttatacataatcacttaaatggcaaacacttgttcaataagcacataattaagttgtttattagtttgtgcataccagagcttaccaatcagaggcagaaaaaacaagcaaccccccaaaaaatttaaatacaatacctgatgatagacccttggagctgttacagaagaaaaaggatccattcctttaacgaagtgattcaaaagaacttctgcagttccaccaatgatgaaagcacctccacttgcacctactacagcttttagcttcccatcctgtataggcatggtaggaaatcattgcaagtaaagaatatgagtaccttgaattaataatagtgaaaggatttcataaccattgcaatcaagatttgttcttttgtatgcttgacaagagtgattgtgtcatttaataaaggttaaattactcagttggtccctagaatatctgaacattttcaagtaggtctctaaactatttgttttttaattaagtccctaaactaaaatttggatccttggattattttatggcagcttgaaatggccagaaaatgataatttatgacggttttaaaaccctagtgactcacttaaaaaatcaaatgatcaagaacccaattaataaattttagtttaaagacctacttgaaatttctcaaatagttcagggaccaattgactaatttcaccttttcttaataaattaaaattcttatatctctatctcttgatgaagctcaacttgagcagtagtgggtgacatggatgataatgtggaagaggatagccacatttaagaaagtcaaatcttgataaaggattgattaccttaagggcaatagtgggtgacatggatgatagtggccgctttcctggcatgatgaaattggcaggagctggtggtggaacatccttggtaacatttctaggcatggaaaaatcatccatttcattgttcagtactattcctgtacttggtgaaaggatctttgaaccaaaatatgcattcacagtgctagtcatggaaatggcatttctctcaggatctattatacttaaatgacttgtaccatgatcatggatctgattccacctgaaaacacaattcagcacaactgagaattctgtattgccacaaacttaattttagtttagaacttatttttacttagatctttatatatatatatatatacaacttagcgcccatacatacaatcattttaaacttccttcttatcatctgttgtcatgttaacacagagtaacacagaatgtaatgtgaggctgctactatacgctggtttgtgaagattgaattcattacttcacttgacggttaaatgacattggtaggtctaactgaataagcctagacaatagatagttattctgttgtaaacagtacatagctgcatcacctctcagtttctgttagtttagccaaatgcatgtatataggacaaatatatatatatatatattagctaaattgaaatcagggctacatttaaggacaaatatatatatatatatatatatatatatatatatatatatatagatagatagatagatagatagatagatagatagatagatagatagacatgtacagcataatcaagttgaccaaatgcctagaacacctaaagtcaacctttatatacaagttgcagacacttcctcaatcaagatatatctttctatgtttcaagttgactatatcatgaaaccaattggtcaagaaattgatatctttcaactctagcttatggagatgcgcaagttatgatgcattaattgtcaatattttctgcattttattcttgtcattcacaccaaaagctgcatattgcaagtgtgtgaggtagaagacaaacatggaatctaaagaacctcattaacttgcacaggcatgaagctacgtgaaaattagtgtaaactcaaagaacttaggagcttacctgctgccgtaatgactggggccaaaagttttattatcatttatgtcatttttcaacacgttagcaaacctatgagaaagcatatcagaaagaaccccagttatatttacaaaatcagggtcaccaagattcattctcacggcaaatacatgcttcaaagcttcaatttctcgatggaaaccaagggcaccagaaaggccagaagggagtttatattgatctagaatgttcagcagctgtaacaaaagacagcattggctaaatcccttaatttgctaattataagatagatataaagaagaaaaaaaattattaacaagaacacaaaggtagtgaatcagatagacttactagcatcattggatgcccacctgaagggggaggcatgccaaggagctttagaccaagaacatcattagatatgggttccttctgtttaacagtgtaacttttgaggtctttcatgctcaatatccctccagcattctggacatctttaactaaattaagaccaatcaatccttcataaaaggcttttggaccagactctgatattgttctgagagtcttggctagtttcttattgtagcaaatgccacctatctttaagagttttccatttggggcaaatatgctacgaagacccttgtcttccaatatatctgactctgtttcttccatctgcttgtggaggtatggtgatactttaaaccctctacgtgctagaatctcagctggctttacaagtcttttccatggaagcttcccatgttgtttccacgcctcatgaaggccagcaagttctccaggaactgctacagataggccacctttggccttcaaagtagtatttccagcatacatatcctgaaaaaaatggataaatcatgtttaatacaccttatcaattgtttataattactttaaaaaaattaagtactacatactttttatggtttaaaatttagttttgttaacatgggtgctgattctaaacatccaaaagtaacaggattttattaagaaagaaaacatttatcacacttatgtttctaatgcaatacaaactgtctttcctaataaaattagtctcagaaactattcctcgagataaaaagattgatttaaggggttcacatcttccaatatgtgttctagcatacacaaagatcgtaggatcaaactcctaaccacataatcaaggggtatggttatttaccaaccatgttggttaaacattttctttttaatacaacaagtacttatttacttctgcattaatttcctgttttattttatgtttttacttttaatttataaaactataacattattttaaatccattttctgttttcaaatgtttgtacagaaaaaagaaaaaaagttgttttcatggttcccttccttaaaaatctctgaaacaagaacccaatttaaaacaatgtatcagttttgtaaactaaaagtgaaagcagaaaatgaaaacacagaaataaacatgcccttgtatttttatcatatactttttattttatttctttaatcattgagtgtctaaagataccattagtctttgtgttgaaaatatcaatgcaaggatatgtgatgatgaaagaaaatgaaataaacaaggagcaaaattttcagttatttttggttttctctctttttcacttgagtctcgatcatacaacaaatttatcaattgaaactacagtaagcagaggaataatccataattgaaaaggaattaatgattcagatggttaaagagttaaaagggtaccttggaggcaagagcaggagcagtttctctcatatcaaaagcctttgccaccccattattcaacctgagaagcaaaaaggctccaccaccaaggccacttgaagcaggactcacaacccccaaacaaagggaagaagccactgctgcatccactgcatgccctccttctctaagaacatccttcccaatccttgagcatctacggtcatcagtggcaacagctccattgtgggcatagatcacctcacctttgtgttttgggtgtccatttgtttcctcaaggcttgaagcaaaggccaaatttgaaaccaaaagcacagcaatgacatgccacaataacacagatacaacaacacttgacatgtatggggacagaatttggtgtagggaatgaaacatttgctgctgacctgttgacttttgaagccgagacatggatggaacttgcttcagttcagtttgctgtaataacataaagcaaaagaatggatggcacttggcagtgtcaaaagtggaaaggactaaggcaacctcggttcttatgttacttttgctttttaagcactgatgtctataagatcctgctattaataggggtatttgtaccttaagtggaagggtttgcctgtgttctgatccggtttaaaattttaataaggtcaattttgactcgacagatatagaatagataagattaggtgaatctgatttattgatataatgtatattaatgttacatataattaaatggtagtattaaaaaagtatactaattatgttatgttttataacatattttaatataaataatattaacataaatatcataatattatgttagaaaaaatattactttttctctcccaaaattaatgttgtattttaaaaaaattatcccaaaataaatgtcatgttaatttattcaatgtagaactaattattttttctagtaatacctctattaaatttctttttaatttttcaatgtaatactaatattatttcctttcatttatttaattggctaattttgttaaattactatttttttattttttttatttttttattagttgttatctaaaacaacactttgagataaaaaaaaaagtatttattaagttaagagtatgtattattaatagaaattatttaagaaatatactttttaaaataaaaatgtataggactatgcaaaatataatatgaattcaagcctggtcaaatcaattgaacgggttacaccaggaacactctcacttattaagcatcccttaaaaagtaagtgtttatttaagacatgtttaagttacttaataaattggcctccaacttacatttccaaagatctccttttgtaacttatacgttgaacttgcattggaatgttcgttaccacactttcaatgatcatgcgcttatacgttgataatgcatcggaatgaacgctaacaaacttctaacgatgaaacaaacatgcacttaagcatcttgttcttaagttttttaacccaattaatatttaaaaactaaaaaaattaatgttacataaattttaagaatgtagggttatttatgagattcgttcagaaatattgtattagaaaaaattgtttaaatcatataagataaaaattagtgatgcataatgataccatccacttaaaatatgcaaagtaaaatgctaaaacaaagatactccaatcatgtgatatgattctttgtaatttaaaaaatattctttgtaattgtaagtaatctctcacgtacctataaaggttttagaaactacaagtttacgattatttttgtctatttaaaatttgtattaataattaataatcaagtttgagtgagaaaaaaataaatatggaacgtctgaataaatagcgtcaaaagacaaagtgctgaagtagcacgagggaattctgaagagttaaggaccactccaccaatcatgttaatggttgagagatgctataggaccgaactcagcctcaaccattcaaatgatgacagttctcaatgaatttcttatttaattaaacattttacatggcacccaagggttgttcaaaaattaaacaaaatcatttataaatcgtcaaattaatctaaaaaaattgcaattggcttaaattgaaaattacaaaaattgaaaattgcatattttttaccgtttagttcgcttttcaaattttgttaaaaaaaaatcaaaccaaaccaccagcgtattataattatattaatttttattgtgataattaataataagtataaaataattatgtactttttagttgctttataatcaaaatatatattttactttcaaatgttaaaaggaatttaccaatattatgaggtagaagacagccagttggacataagcaataaaaagataaataaaacttaactaaaaatcatttttatcaaatatccaattcatcatatattattcaattatataatatttgattgtgaataactcatctttcaaattgcaaaccaagtcatacgcggacaaattaattgctagagcatttgagtggctgctttaagtcaaattatggcaaacatactggaaggtcaacacgcaactgcagtcaacgtgtctgttttaattttttcttcttctaaaaaatacattaaacctgatttttagaactcgtttaggtcaaatggctttgggttcgtcaagttatgatcagattgtatgttgttaagtctttactcttcttaaatagactttttcaggcataaaacagttatttaaaagacaaattataaccctctcaagtctcaaacttttgacaattttttttttttcattttgttacaagcaaactattaatcttttgaaaataaaagttgacctgggaagtggttgcacacagcatctaggaaaaaagtcaaaaagcaacgctggattagaacaaaatataattattgtttatttttctttctttctttctttttcattttttaatgacatctttttccattgttgtaatggcagaaatcagtgttcagtgattgatgatggtcccgatctgatcaaagattcaaagacaatccttttgctcacgttgtgagttgttttataaattggacaatcaaaattgcatgacaaaatttacaaactacaatgttctcagatgtcacgtgaaatagatgatgcacagtactactttaattatagtagtgttcaaaaatgagaaattttaagattattcaaaaatcttgaaatattttaaattgaaattaaatttaattaaatctctttgattttttaaatattctgtttagatagagagaatttcgatgtcagtattgttatccaaagactatttgacaacgaaatcgacaaaagaaagagagaaaggagagagatgggaagagcatagagagaaaatagagataggactaaggagaaaaaataagtaagaagaatttcaaattcttgctttttgactttttagtgtaaaaattgaaatattttattttaaatagttaaagcatttcaagaaattaatataatttcaaatactttttaaatacattattcaaataacttattagttttttttctcggagacttgagaattttagtgtacttttaaatctgatttttttttaaatagcggaaatcaggtttaaaagagtctacggataattagtatgaatacaaagattgggcctgagctcgaattaagcccagattacctggggaaaacaacagataaatttacatgaataattttttttttctaatttgtctgatttctttctgtaaaaatattaaatgcgttttatatttttaagacattaaacgtatttatttttatttaacatttttataaaatagtagaaagttttattaagagaatatatcagtactcaattcacataatgtcattgtccaaattccaaatatctggacgcattaaagtgaagttacctgttgattgatcatgatctacttatcttggatgtactataaaagcccaatatggatacacatagaagctagcccaaactgttcaatcctatcactgacccgtttaaaacaaaatggatgagttgaccagttttggaaaagtgggtggttaaaaatctcaattggtctcattcaaatgtgggttgatttgaaaaaaaacaaaataattatgaaaatgtgctaaaaaaaccaaattttattataattgagtttgtacgttaatcactcatattttcattttataatcttaaaaaaaaactttgaaacatggtgtatgtcaatatgacttatttaaactatagttttttttttactatttaaactatggtttgttaaaaataaaacatagttaaataagttatagtaaaggtactcttgttcttcaaaaaaaaaaaaaaaagaggtaaagatactcttgtaactaaattttcttatttctccgtatcactagaccatgagcattcaatgaatacataacaatgatttgtttgttggttgcctaaaactcagacttgtacgataaaaggatgactacaagtcaacaacaaatatagaagaaataaaatcaaaaaaaaattggccaaattatgttacatatgattttactttaatttaactccataaaaaaagttctatacatgagaagtacaaattgaataaaatggtatgatttttttaattttcatttgtttcaattaatgatttaattgattttcagtttatttaattatttaatggtttaatacattttttttattacagcagaaagacaaaatctatctactcctcatatgcattaccccaagcgcatcagcaagtacccgaggaagaagacccgctggacatgatgacagaaggatttaatacgatttgaatacattttttagaaacaactctatcaaaattattgacggtacctaaattgattgtatatttcaagcttaattatgtttttaatatcaactaggggttggttttttagtctttcaaataaaaatatatatatttttagtcttttaaattaaaacaaaaattgtttttagctcccttccaccatctttttccaaaacaaacatagagtagttatagttgttctatcttgtgtcttttagcaaatcaaagagattctaaaaagagagtatttctttaattcgagagattaaaaattacaaattgtcatttgaaagactactaattaaaagttcaaaaaataattaagtttatattttattactattgctaaacttttttccaaaacaaaaatgctaaaatgaggctaagtacacgttggtggtgacacaggaaacttcccttcatatgccttgtcagtatattaatttacgaataacttgtgctccatgtgattcgattttatttaagtgtaattttttttcttgaggcgaagataatattataatataaaaaggatccaaaaccacaatcaaggagtgatgatttcggaccaaaattgtttgtttaattaaagcatacttctgtctaacttatagagttgacaagtaaattaatactatcactaaatctccactttactattttttaaaaataaaatttaaatttatgatgatattaattaaattaaaaactaaataattataattttgatcttcttgtaattcttaatatgtaattttggtattcttattttaaaaaattataattttaattcaatattcaactttccgtatatttattttttattttaaattttcacaatttcaatctacttatttaatttatttgagttatcatattataaataaaaaatattcattatttttctttatatacaaaacttacaagattttatttaagaaatttgaatccaattttactcctactatcaacttgtttttgtataattatttactttaaagaatataaaagtacaacctatgttatattgttagttaacaataattatcgaggatcacgatgattttgtaaagaattatatctatgcaattttttctttatatacaaagctt

SEQ ID NO: 7233 - DNA, 270 bp, Zea mays
gttatccatgtttctgaaatcgaagagtggaatatggtcaaaagcctacatatcaagacggtggatgaacttggacttccaagatctgtaatacaagacatgctagatgaactggagcaactattgaaaggtatcgctatgatgaaagagctgacgcctaggaccagtgactaccttgtttcatttggagaatgcatgtccaccaggatttttctgcttatttgaacaaaattcgtgtcaaggcacggcagtatgacgcatttgatattg

SEQ ID NO: 7234 - DNA, 309 bp, Glycine max
  misc_feature (142)..(142): n is a, c, g, or t
  misc_feature (293)..(293): n is a, c, g, or t
  unsure (1)..(309): unsure at all n locations
ctcggaattcggctcgagccgagggaaaaacttggcaacctacacacccagtgtggacatgggtgcgtttgtaattgtggtaaatgcagaaaaggttgctgtatctgggaaaaagaggacccaaaagctttacaggaggcantctggacgacctggtggtatgaccgtggagacatttgcccagctgcaaaacagaattcctgaaagaattattgaacacgctgttcgtggcatgcttccaaaaggaaggcttgggaggagactattcacccaccttaaggtttataaaggcncagatcatccacatgc

SEQ ID NO: 7235 - DNA, 345 bp, Glycine max
  misc_feature (5)..(5): n is a, c, g, or t
  unsure (1)..(345): unsure at all n locations
gcacncgtacgtaagctcggaattcggctcgagcatcgtttttaggaatatcacgattttcgtttcgccaattcgtgaaatcgaaagattcccacagaattgtacgaattattgttcatttttttgtctctactgtcgtgctccaacttggtaaactagaagttcatttattgttttcattcttcaatgggggatgctggaatgcccttccacctacaaagaaaagggctgctggaagggagctcactcgagacactcccattgatgatgaggaagatgcccccgagcttgagactggcatttcaagagagccagtgaagaggttctggcaaccagaaggatggt

SEQ ID NO: 7236 - DNA, 212 bp, Glycine max
  misc_feature (1)..(1): n is a, c, g, or t
  misc_feature (28)..(28): n is a, c, g, or t
  misc_feature (45)..(45): n is a, c, g, or t
  misc_feature (109)..(109): n is a, c, g, or t
  unsure (1)..(212): unsure at all n locations
ngaagtcgcatgcacgcgtacgtaagcncggaattcggctcgagnattaatttgcactctaccgagttattttctctgttgtaggagcgctttcaaggccttgattgcntccttgctggtacatatccttttattggccatgtaacatttgagacatatgtttcctgctcaagtattgtggaacaaaacttacacctgctgcagcgcctgct

SEQ ID NO: 7237 - DNA, 332 bp, Glycine max
  misc_feature (7)..(7): n is a, c, g, or t
  misc_feature (20)..(20): n is a, c, g, or t
  misc_feature (332)..(332): n is a, c, g, or t
  unsure (1)..(332): unsure at all n locations
cgtcgangcacgcgtacgtnagctcggaattcggctcgaggacatggtcttgaagaatgacctaagtgtggttagaaatgattctccacttctactcactaggacctttttacataggagttcatctaccccttgcctttcacctactggcagggatcttctgcagagggatcagagtggaccaattgaggttataggttgctcagatatgttttcaggaaccaaacagctggttaaggatattatgaaggcaataaaagttggcattgaacctatccccattcagagtggattaggaggtgcatattattttaggaacagcaatggtgaan

SEQ ID NO: 7238 - DNA, 233 bp, Zea mays
gtttttgcagttagtagaatatgttagtggctcctatgatagggtggaaggatttgagttattgaatgaggcaatctctgagtatgagacttcagaaaacaatgactcgggaagctaccgcagattattttatttggcattgcctccatcagtctacccatcagtatgcgagatgataagatcatattgcatgagtccatcttcacacaccggttggacaagggttattgttg

SEQ ID NO: 7239 - DNA, 337 bp, Glycine max
  misc_feature (117)..(117): n is a, c, g, or t
  misc_feature (122)..(124): n is a, c, g, or t
  unsure (1)..(337): unsure at all n locations
cacgcgtacgtaagctcggaattcggctcgagaaattcttccaccaagttatgggtttccttgtgttgcttcttttctccctcttaggtctctcttctagttccagcatatcaactncatcnnncccatattggaccttgacctaaccaagtttaccacacagaaacaggtgtcttcactgttccaactatggagagtgagcatggacgtgtctaccataaccacgaagaagaggcaaagagacttgagattttcaagaataacttgaactatatcagggacatgaatgcaaacagaaaatcaccccattctcatcgtttaggatgaacaagtttgc

SEQ ID NO: 7240 - DNA, 251 bp, Glycine max
  misc_feature (6)..(6): n is a, c, g, or t
  unsure (1)..(251): unsure at all n locations
tcgcangcacgcgtacgtaagctcggaattcggctcgagggcgtcttcaatcgaaaagctcctagaaagtggtcgtcccttccttcgcggcgatctggagtccatcgacaagaacttacctcggctggttggcgtcctgcagagtgtgggtgccggggagtgctggcacaaacacggcagcttccttcaccacctcgtcgacatatttcgcattctcaagctctggaaagcccctcactctgtctgcctct

SEQ ID NO: 7241 - DNA, 182 bp, Glycine max
  misc_feature (2)..(2): n is a, c, g, or t
  misc_feature (36)..(36): n is a, c, g, or t
  misc_feature (177)..(177): n is a, c, g, or t
  unsure (1)..(182): unsure at all n locations
cngcacgcgtacgtaagctcggaattcggctcgagngcttcttcgtcttcagaatcggcggtgtcgagcgaagaggaataccaggggctcagttcgtagaggatgtccaaacttacctcactcaatcgggtctcgatgttggttcagccctggcttttctccaagagagacttcagnagtac

SEQ ID NO: 7242 - DNA, 179 bp, Glycine max
gcgtacgtaagctcggaattcggctcgagcttcttctcttgcggctagggttttagcgcacttcttctagatttaaggaagatgggtaaggaaaaggttcacatcagtattgtggtcattggccatgtcgactctgggaaatccactaccactggtcacctgatttacaagcttggagg

SEQ ID NO: 7243 - DNA, 1170 bp, Zea mays
ccagagatggcttaagcaccatgactactgctggttatgatgcccctgcagcaaggttggccaaaaggaagaggaagaatcaatacaggggtatccgccagcgcccttggggtaagtgggctgctgagatcagagatccccagaagggcgttcgtgtttggcttggtactttcaatagtcccgaggaagctgcaagagcttatgatgctgaagcgcgcaggattcgtggcaagaaggccaaggttaactttcctgatgcaccagcagttggtcagaagtgccgttctagttcagcttctgctaaagcactcaagtcatgtgttgaacagaagccaattgtcaaaacagatatgaacatccttgccaacacaaatgcacccttctaccaatctgttaactacgcatccaacaatccatttgttccagcaatgaactctactgtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaggatcttggtagcaatatggacctctggaccttcgatgacatgcccatcgcttgcgatttcttctgaggaatttgaagcttggccataggactatgtacatagggactagggaataaagactgggagattgggaagcacctgcttggcaccttggggtagcatatgctcgtgtctagctcagatgcagaagtcgcattctgaaactctttggttatcgacctgttccctattttaactatctctgtatgagagccatttatgagactgaaccattttaccattttgttttcccccttctttcgttgttacagtatatggtttaacattatgatttatggatatgtggccaaacatgccttttataaaaaaaaaaaaaaaaaaaaaaaaaaaaaaaaaaaaaaaaaaaaaaaaa

SEQ ID NO: 7244 - DNA, 341 bp, Glycine max
  misc_feature (113)..(113): n is a, c, g, or t
  misc_feature (175)..(175): n is a, c, g, or t
  misc_feature (311)..(311): n is a, c, g, or t
  unsure (1)..(341): unsure at all n locations
gtcgcatgcacgcgtacgtaagctcggaattcggctcgaggctttctcttccttcataatttctcacctttcaaatctccattcagcttcattttctgcataggaaaaaaccnttttcctggagaaagattatagtccttcagctggacaaaggatcattcatccttgaaaagangagttgtgtgtgacaatcttatagttctaaggaggtgcaagagagaactgaatttgctgtgatggcaactcgtagatatgcttttggaagagctgtgaggccatcatccagactccatgagggccacttggctganttgttctacttcacttgtcttgcggagaag

SEQ ID NO: 7245 - DNA, 137 bp, Glycine max
  misc_feature (1)..(1): n is a, c, g, or t
  misc_feature (4)..(4): n is a, c, g, or t
  misc_feature (17)..(17): n is a, c, g, or t
  misc_feature (38)..(38): n is a, c, g, or t
  misc_feature (49)..(49): n is a, c, g, or t
  misc_feature (58)..(58): n is a, c, g, or t
  misc_feature (64)..(64): n is a, c, g, or t
  misc_feature (74)..(74): n is a, c, g, or t
  misc_feature (81)..(81): n is a, c, g, or t
  misc_feature (83)..(83): n is a, c, g, or t
  misc_feature (88)..(89): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (106)..(108): n is a, c, g, or t
  misc_feature (113)..(113): n is a, c, g, or t
  misc_feature (115)..(115): n is a, c, g, or t
  misc_feature (118)..(119): n is a, c, g, or t
  misc_feature (122)..(122): n is a, c, g, or t
  misc_feature (125)..(125): n is a, c, g, or t
  misc_feature (127)..(127): n is a, c, g, or t
  misc_feature (131)..(132): n is a, c, g, or t
  misc_feature (134)..(136): n is a, c, g, or t
  unsure (1)..(137): unsure at all n locations
ntgngcacgcgtacgtnagctcggaattcggctcgagntaaaaattagntaatttatntcgatngtattagacngagaccngncaaanntgaangtgagnananannnaaacngntanngcngcncntcgnnannnc

SEQ ID NO: 7246 - DNA, 412 bp, Glycine max
gaaccttccggatttcgttttgctttgttcaggtagccagccagtcatggtgctcttcaatgtttcacgcgtagagaccactcccttcgatggccagaagcctggaacctctggtctccgcaagaaggtgaaagtgttcgtgcaacctcattacctccataactttgttcagtcaacattcaatgcattaactgtggaaaaagttagaggtgcaacgctagttgtatctggtgatggtcgttatttttcaaaggaagctattcagattataactaaaatgtcagcagcaaatggagtaagacgtgtttggattggtcaaaatggattgctttcaactcctgcagtatctgctgttatacgtgaaagagttggagctgatggattcagggcaacaggtgcatttatactgaca

SEQ ID NO: 7247 - DNA, 490 bp, Glycine max
  misc_feature (15)..(15): n is a, c, g, or t
  misc_feature (35)..(35): n is a, c, g, or t
  misc_feature (90)..(90): n is a, c, g, or t
  misc_feature (148)..(148): n is a, c, g, or t
  misc_feature (213)..(213): n is a, c, g, or t
  misc_feature (231)..(231): n is a, c, g, or t
  misc_feature (236)..(236): n is a, c, g, or t
  misc_feature (246)..(246): n is a, c, g, or t
  misc_feature (269)..(269): n is a, c, g, or t
  misc_feature (293)..(293): n is a, c, g, or t
  misc_feature (312)..(312): n is a, c, g, or t
  misc_feature (317)..(317): n is a, c, g, or t
  misc_feature (320)..(320): n is a, c, g, or t
  misc_feature (322)..(322): n is a, c, g, or t
  misc_feature (328)..(328): n is a, c, g, or t
  misc_feature (334)..(334): n is a, c, g, or t
  misc_feature (338)..(338): n is a, c, g, or t
  misc_feature (351)..(351): n is a, c, g, or t
  misc_feature (368)..(368): n is a, c, g, or t
  misc_feature (400)..(401): n is a, c, g, or t
  misc_feature (405)..(405): n is a, c, g, or t
  misc_feature (411)..(412): n is a, c, g, or t
  misc_feature (418)..(418): n is a, c, g, or t
  misc_feature (423)..(423): n is a, c, g, or t
  misc_feature (431)..(431): n is a, c, g, or t
  misc_feature (473)..(473): n is a, c, g, or t
  misc_feature (478)..(478): n is a, c, g, or t
  misc_feature (480)..(480): n is a, c, g, or t
  unsure (1)..(490): unsure at all n locations
ccacgcgtccgtacngctgcgagaagacgacagangggggcacaagtttgttgagatagctagaagcaataagatgaaaatgaaagtgcntgttttgtttgttgctacagttttggtagcatatgaatgccatggctcagactaccanaagttccctctccaaatgaaaactgggtttggtgggcaatacagcaatgaagtggcatgtgccanttggaggcttggcgtggnagcanacaacgtagncaagtggcaaactgttcctgcancttgcggagagtacatagctgacnacgttctaagagaccaatntgagntcngngtccanggcagntaancaacaaagcgtanttctatgctaaatcccncaaactcaccaacaaagatgtccttggcctgnngcgntgacgnnaactantcccnccaaatcnccagtattttgccaaaccaatggatttggggttggaaccacncaatncnaacggggttt

SEQ ID NO: 7248 - DNA, 530 bp, Glycine max
  misc_feature (2)..(2): n is a, c, g, or t
  misc_feature (19)..(20): n is a, c, g, or t
  misc_feature (26)..(26): n is a, c, g, or t
  misc_feature (28)..(28): n is a, c, g, or t
  misc_feature (427)..(427): n is a, c, g, or t
  misc_feature (478)..(478): n is a, c, g, or t
  misc_feature (488)..(488): n is a, c, g, or t
  misc_feature (501)..(502): n is a, c, g, or t
  misc_feature (507)..(507): n is a, c, g, or t
  unsure (1)..(530): unsure at all n locations
gnaactgtttacgcctggnncgtacngngtccgaaaattcccgggtcgacccacgcgtccgacggctgcgagaagacgacagaagggaacaacatatattaaaaaaataacaacatatattaaaaaagtcagaataaaaaaacaaatcctttatagtatttcttgtaataaatgtgatttttggaatagggataaataaaccatggaaaaatctaagcgactctttatgaaatccaagcgatcttttcgtaggcgtttgcccccgatccaatcgggggaccgaattgattataaaaacatgggtttaattagtcgatttattagtgaacaaggaaaaatattatccagacgcgtaaatagattgaccttaaaacaacaacgattaataacaattgctataaaacaagctcgtattttatcttgttancttttcctaataatgaaaaacaatttgaaaaaaagcgagtcaaccgctagnaactactacntttaagaaaaaannaaatnttgaaattaagaaattccaaatc

SEQ ID NO: 7249 - DNA, 494 bp, Glycine max
  misc_feature (2)..(2): n is a, c, g, or t
  misc_feature (4)..(13): n is a, c, g, or t
  misc_feature (20)..(20): n is a, c, g, or t
  misc_feature (22)..(22): n is a, c, g, or t
  misc_feature (64)..(64): n is a, c, g, or t
  misc_feature (432)..(432): n is a, c, g, or t
  misc_feature (468)..(468): n is a, c, g, or t
  misc_feature (477)..(477): n is a, c, g, or t
  unsure (1)..(494): unsure at all n locations
gngnnnnnnnnnnccttccncngccagtaccggtcaaagaattcccgggtcgacccacgcgtcngtacggctgcgagaagacgacagaaggggaaggcgtacaggtgcagtccagcagtcccagcagcccgttccaatgatgccacagcagatgctacctagggggcgtgtctatcgttatcctcctggtaggggtatgccagatgtttctatgcccggggttgctggaggtatgttttctgttccatatgatgtgggtgggatgccactgcgtgatgcatcaatctcccagcaaattcctgttggggctttagcaacagctctggctaatgcttctccagagcagcagaggacgatgctgggtgagaatctctacccccttgtggaacagttagagcctgacaatgctgccaaagtgacaagcatgcttcntgagatggaccaagactgaagttctgcatttgctcnagtcgccanaagccctgaaagcaaag

SEQ ID NO: 7250 - DNA, 469 bp, Glycine max
  misc_feature (13)..(13): n is a, c, g, or t
  misc_feature (25)..(25): n is a, c, g, or t
  misc_feature (32)..(32): n is a, c, g, or t
  misc_feature (52)..(52): n is a, c, g, or t
  misc_feature (168)..(168): n is a, c, g, or t
  misc_feature (338)..(338): n is a, c, g, or t
  misc_feature (391)..(391): n is a, c, g, or t
  misc_feature (439)..(439): n is a, c, g, or t
  misc_feature (443)..(443): n is a, c, g, or t
  misc_feature (463)..(463): n is a, c, g, or t
  misc_feature (466)..(466): n is a, c, g, or t
  unsure (1)..(469): unsure at all n locations
tttacgcgcccangtaccggtaaangaattcncggctcgacccacgcgtcangctgaaccacattatcaagtctacaaatatgaagtgcctgactccaccatcggcattggaaggggattgtggattccttgctgcaaacctttatgctaagagtgtttttggggaanatgctttggtgaatgtgagcattgaaaagcaatcagatggtaagttgagtggatacatcagaataagaagtaaaactcagggaattgccctcagtcttggggataagataactttgaaacagaagggagccgcttaataggagtaaatgcccgttttctctgatgtttcntcgcttatatcaactttgtgtagcttcttgtggcggctaacttcaagcttggntattgcttcaaattctgcggcttttggtggcaacccgcctgttagtantaanttttttttccccttttgaanttncaa

SEQ ID NO: 7251 - DNA, 410 bp, Glycine max
  misc_feature (334)..(334): n is a, c, g, or t
  misc_feature (358)..(358): n is a, c, g, or t
  unsure (1)..(410): unsure at all n locations
agaaagcaatggctacttcaaagttgaaaacccagaatgtggttgtatctctctccctaaccttaaccttggtactggtgctactgaccagcaaggcaaactcagcggaaactgtttctttcagctggaacaagttcgtgccgaagcaaccaaacatgatcctccaaggagacgctattgtgacctcctcgggaaagttacaactcaataaggttgacgaaaacggcaccccaaaaccctcgtctcttggtcgcgccctctactccacccccatccacatttgggacaaagaaaccggtagcgttgccagcttcgccgcttccttcaacttcancttctaagcccctgacacaaaaanggcttgcaaatgggcttgccttctttctcgcaccaattgacactaagccaca

SEQ ID NO: 7252 - DNA, 290 bp, Glycine max
tcgagaaattataacacataaattacatggcttgcttatgaattaaagcaattttgggatttccatataatttttctttctattttttgtccggatagtcttatttcaaaaatgagattgtgtaaagggtttaaactttgaatgttgttgcaacttgcaaaggttgtgtttagatctggtcaatgtaaaatttgttgaaactatatccatggatcattcttgatggacaatggcatcttgtgatgcatgtaacatgattccccccgatggatattggattgttgttattt

SEQ ID NO: 7253 - DNA, 377 bp, Glycine max
  misc_feature (67)..(67): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (332)..(332): n is a, c, g, or t
  misc_feature (334)..(334): n is a, c, g, or t
  misc_feature (338)..(338): n is a, c, g, or t
  misc_feature (364)..(364): n is a, c, g, or t
  misc_feature (372)..(372): n is a, c, g, or t
  unsure (1)..(377): unsure at all n locations
attaacggctgtcatggtgtctttcacactgcttctcccgtcaccgataaccccgaagaaatggtgngagcctgcggtgaatggagctaagaatgtgatcatagcagctgcagaggctaaagttagacgcgtggtgttcacctcatccattggtgccgtttacatggaccccaaaaggagcatcgatttggtggttgacgagtcctgttggagtgatttaagaattttgcaagaacaccaagaattggtattgctatgggaaagctgtggctgaagaagcggcatgggacacagcacaaagagaaaagggtggacatgggtntantnaaccncntttngggactttggcccattagggaacccnccaaaaanggcct

SEQ ID NO: 7254 - DNA, 405 bp, Glycine max
  misc_feature (3)..(3): n is a, c, g, or t
  misc_feature (8)..(8): n is a, c, g, or t
  misc_feature (19)..(19): n is a, c, g, or t
  misc_feature (23)..(23): n is a, c, g, or t
  misc_feature (27)..(27): n is a, c, g, or t
  misc_feature (30)..(30): n is a, c, g, or t
  misc_feature (35)..(35): n is a, c, g, or t
  misc_feature (42)..(42): n is a, c, g, or t
  misc_feature (45)..(45): n is a, c, g, or t
  misc_feature (47)..(48): n is a, c, g, or t
  misc_feature (50)..(51): n is a, c, g, or t
  misc_feature (60)..(60): n is a, c, g, or t
  misc_feature (69)..(69): n is a, c, g, or t
  misc_feature (72)..(72): n is a, c, g, or t
  misc_feature (105)..(105): n is a, c, g, or t
  misc_feature (113)..(113): n is a, c, g, or t
  misc_feature (120)..(120): n is a, c, g, or t
  misc_feature (123)..(123): n is a, c, g, or t
  misc_feature (135)..(137): n is a, c, g, or t
  misc_feature (146)..(146): n is a, c, g, or t
  misc_feature (149)..(149): n is a, c, g, or t
  misc_feature (154)..(154): n is a, c, g, or t
  misc_feature (160)..(160): n is a, c, g, or t
  misc_feature (162)..(163): n is a, c, g, or t
  misc_feature (166)..(166): n is a, c, g, or t
  misc_feature (168)..(170): n is a, c, g, or t
  misc_feature (177)..(177): n is a, c, g, or t
  misc_feature (181)..(181): n is a, c, g, or t
  misc_feature (186)..(186): n is a, c, g, or t
  misc_feature (189)..(189): n is a, c, g, or t
  misc_feature (196)..(196): n is a, c, g, or t
  misc_feature (202)..(202): n is a, c, g, or t
  misc_feature (209)..(210): n is a, c, g, or t
  misc_feature (213)..(213): n is a, c, g, or t
  misc_feature (216)..(216): n is a, c, g, or t
  misc_feature (223)..(223): n is a, c, g, or t
  misc_feature (226)..(227): n is a, c, g, or t
  misc_feature (239)..(239): n is a, c, g, or t
  misc_feature (243)..(243): n is a, c, g, or t
  misc_feature (275)..(275): n is a, c, g, or t
  misc_feature (284)..(284): n is a, c, g, or t
  misc_feature (323)..(323): n is a, c, g, or t
  misc_feature (326)..(326): n is a, c, g, or t
  misc_feature (333)..(333): n is a, c, g, or t
  misc_feature (335)..(335): n is a, c, g, or t
  misc_feature (356)..(356): n is a, c, g, or t
  misc_feature (376)..(376): n is a, c, g, or t
  misc_feature (381)..(381): n is a, c, g, or t
  misc_feature (393)..(393): n is a, c, g, or t
  misc_feature (395)..(395): n is a, c, g, or t
  misc_feature (402)..(402): n is a, c, g, or t
  unsure (1)..(405): unsure at all n locations
tcngctcnagctcgactcncctnactnatnccacntcatggntcntnngnntttgaatgntccggttcnggngcatgcccacgttttgtgcatactgttgaatangatgttcngcctacngcnggacaccgctcnnncctcagtanacnactgngaacangnntcngnnngtttgcncacntctgnganataaaanggtccnttttccnnagntgnataaagntgnngtagacggtggnatcntcaggtttcccgtactgttaacgggtggatanaataatggnacatgggaattcctctccacttgcaaccttatctgttgntcnggggtantngccactccattgtggaatacntgaatccgggtaaatggtantttgnatccgtcctccngntaaaccnttc

SEQ ID NO: 7255 - DNA, 432 bp, Zea mays
  misc_feature (43)..(43): n is a, c, g, or t
  misc_feature (45)..(45): n is a, c, g, or t
  misc_feature (59)..(59): n is a, c, g, or t
  misc_feature (95)..(95): n is a, c, g, or t
  misc_feature (101)..(101): n is a, c, g, or t
  misc_feature (124)..(124): n is a, c, g, or t
  misc_feature (133)..(133): n is a, c, g, or t
  misc_feature (147)..(147): n is a, c, g, or t
  misc_feature (152)..(152): n is a, c, g, or t
  misc_feature (161)..(162): n is a, c, g, or t
  misc_feature (165)..(165): n is a, c, g, or t
  misc_feature (204)..(204): n is a, c, g, or t
  misc_feature (206)..(206): n is a, c, g, or t
  misc_feature (214)..(214): n is a, c, g, or t
  misc_feature (232)..(232): n is a, c, g, or t
  misc_feature (247)..(247): n is a, c, g, or t
  misc_feature (250)..(250): n is a, c, g, or t
  misc_feature (273)..(273): n is a, c, g, or t
  misc_feature (277)..(277): n is a, c, g, or t
  misc_feature (292)..(292): n is a, c, g, or t
  misc_feature (294)..(295): n is a, c, g, or t
  misc_feature (298)..(298): n is a, c, g, or t
  misc_feature (301)..(301): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (322)..(322): n is a, c, g, or t
  misc_feature (324)..(324): n is a, c, g, or t
  misc_feature (336)..(336): n is a, c, g, or t
  misc_feature (339)..(339): n is a, c, g, or t
  misc_feature (345)..(345): n is a, c, g, or t
  misc_feature (354)..(354): n is a, c, g, or t
  misc_feature (356)..(358): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (372)..(373): n is a, c, g, or t
  misc_feature (377)..(377): n is a, c, g, or t
  misc_feature (380)..(382): n is a, c, g, or t
  misc_feature (384)..(384): n is a, c, g, or t
  misc_feature (386)..(386): n is a, c, g, or t
  misc_feature (389)..(390): n is a, c, g, or t
  misc_feature (392)..(392): n is a, c, g, or t
  misc_feature (394)..(395): n is a, c, g, or t
  misc_feature (402)..(402): n is a, c, g, or t
  misc_feature (406)..(406): n is a, c, g, or t
  misc_feature (408)..(408): n is a, c, g, or t
  misc_feature (414)..(416): n is a, c, g, or t
  misc_feature (419)..(419): n is a, c, g, or t
  misc_feature (422)..(422): n is a, c, g, or t
  misc_feature (424)..(424): n is a, c, g, or t
  misc_feature (429)..(430): n is a, c, g, or t
  unsure (1)..(432): unsure at all n locations
ggataccaacagagaacagggagcattccgaaatcccttccgntncggccaacccgccngcgacccacgcgtccgcgagaacccatggccaaatnttgatnctcacagcggagttttgctgaanggcttgggncaatctgaagcacngtagnacactgccnngtncggggtttcaagaagcatggggataggatctcagctcancngggaccgngccctaggccagccactngagaggccgaagagngcnaccatggagaggctggaagaacnaccncaagaacaaggcganannaancananaanganatgccacaaagcncncaaacacagaanggnaagaanacaaaacancnnnggaaaggnananannaagnggnnncncngannangnnaaacaanactngnaaccannnacncanangcagnnga

SEQ ID NO: 7256 - DNA, 377 bp, Zea mays
  misc_feature (2)..(4): n is a, c, g, or t
  misc_feature (8)..(8): n is a, c, g, or t
  misc_feature (12)..(16): n is a, c, g, or t
  misc_feature (20)..(20): n is a, c, g, or t
  misc_feature (24)..(24): n is a, c, g, or t
  misc_feature (29)..(29): n is a, c, g, or t
  misc_feature (54)..(54): n is a, c, g, or t
  misc_feature (111)..(111): n is a, c, g, or t
  misc_feature (115)..(115): n is a, c, g, or t
  misc_feature (138)..(138): n is a, c, g, or t
  misc_feature (143)..(143): n is a, c, g, or t
  misc_feature (154)..(154): n is a, c, g, or t
  misc_feature (156)..(156): n is a, c, g, or t
  misc_feature (168)..(168): n is a, c, g, or t
  misc_feature (175)..(175): n is a, c, g, or t
  misc_feature (238)..(238): n is a, c, g, or t
  misc_feature (283)..(283): n is a, c, g, or t
  misc_feature (290)..(290): n is a, c, g, or t
  misc_feature (293)..(293): n is a, c, g, or t
  misc_feature (296)..(296): n is a, c, g, or t
  misc_feature (299)..(299): n is a, c, g, or t
  misc_feature (302)..(302): n is a, c, g, or t
  misc_feature (308)..(308): n is a, c, g, or t
  misc_feature (310)..(311): n is a, c, g, or t
  misc_feature (321)..(321): n is a, c, g, or t
  misc_feature (324)..(326): n is a, c, g, or t
  misc_feature (329)..(329): n is a, c, g, or t
  misc_feature (331)..(332): n is a, c, g, or t
  misc_feature (335)..(338): n is a, c, g, or t
  misc_feature (340)..(340): n is a, c, g, or t
  misc_feature (346)..(347): n is a, c, g, or t
  misc_feature (352)..(355): n is a, c, g, or t
  misc_feature (358)..(358): n is a, c, g, or t
  misc_feature (360)..(360): n is a, c, g, or t
  misc_feature (364)..(364): n is a, c, g, or t
  misc_feature (368)..(368): n is a, c, g, or t
  misc_feature (372)..(373): n is a, c, g, or t
  misc_feature (376)..(376): n is a, c, g, or t
  unsure (1)..(377): unsure at all n locations
gnnnaggngttnnnnnacgnaatnccttntgccatttgcaaaaccccaccggtncggaattcccgggccgacccacgcgtccgctctggtccgtggccatggcgttttccntttntctccgctaccaccgtgccactncagcnggggggctggnanagtccgagtgcnccgggcncaggagctccgcgtcgctgcccatgcgccggaatgccacctccgacgacttcatgtccgccgnctccttcaggacccacgcggtcggcacgagcggcgggtcgcggcnggcgccnacngangcnaanctgaangnngccatcaacnggnnnggncnnatnnnncncaactnnctgcnnnncangnaaangacnaagnnaana

SEQ ID NO: 7257 - DNA, 482 bp, Glycine max
  misc_feature (442)..(442): n is a, c, g, or t
  misc_feature (470)..(470): n is a, c, g, or t
  unsure (1)..(482): unsure at all n locations
gaaacgcaacaatggctcaagcggttgaagaatggtataagcagatgcccgtcatcacgcgctcctatctcaccgctgctgttgtcaccactatcggatgctcccttgatataatttctccgtatcatttgtacttgaaccctatattggtggtgaagcaatatcagttttggcgcctggttactaatttcttgtactttcgtaaaatggacttggatttcctgtttcatatgttttttcttgctcgttactgcaagcttcttgaggagaactcgttcagggggaggactgctgatttcttttacatgctcttatttggtgccactgtattgactggaattgttcttcttgggggcatgataccttatttatcagagtcgttcgcaaaaataatattccttagcaactcattgacatttatgatggtttacgtgtggagcanacaaaatcccttcattcacatgagcttnctggtctcttta

SEQ ID NO: 7258 - DNA, 477 bp, Glycine max
cttgctagtttgtttatcactcactcactcactctttgaaatgggtaaacaagtattgaattcctttcctctcatcgttttcttcttcattttgttttccactgtttccgctgatgaagtttccaagaccttcatcttccgcgtggattcccaatccaagcccaccgtgttccccactcactaccattggtacacctccgagttcgcccaagaaaccagcatcctccacttatacgacaccgttttctgcggcttctccgcagtgctcacaagccaccaagtcgcgtccataagccaacacccttccgtcctcgccgtcttcgaagaccgccgccgtcagcttcacaccacgcgctccccgcagttcctcggcctccgcaaccagcgcggcctctggtccgaatccgactacggctccgacgtcatcgtcggagtcttcgacaccggcgtctggccggaacgccgcagcttctccga

SEQ ID NO: 7259 - DNA, 444 bp, Glycine max
attttctcactccccatcttctgagagcgatgggtgtatgctaccgatgatcccacacctgccacaggaccggcatcatcatcaccagcttcttccgtcacaagccttagaattatactattcccaccctgcctctctcttcaacatcaaccgttgactacactacagtgcacgtggtctttctctgaggatccaaccatggcggctggaactgtcttctgcgctgctgctactgctgcttctaattcgacaacaaccacttttattcacaaccaagcaccttcttccacctcctatgagcctactgtcgattctctcttcctatgtgcctcttaccctttcctcggatcaagatctatagtgagttttggagatgttcatggaaggaaggggtgcaatgatgcattcttgcgcccttatgatgagaatggggatgaggacatg

SEQ ID NO: 7260 - DNA, 57 bp, Glycine max
  misc_feature (2)..(3): n is a, c, g, or t
  misc_feature (8)..(8): n is a, c, g, or t
  misc_feature (13)..(13): n is a, c, g, or t
  misc_feature (26)..(26): n is a, c, g, or t
  misc_feature (38)..(38): n is a, c, g, or t
  misc_feature (45)..(45): n is a, c, g, or t
  misc_feature (52)..(52): n is a, c, g, or t
  misc_feature (54)..(54): n is a, c, g, or t
  unsure (1)..(57): unsure at all n locations
cnnttttnatggnccgccgtttgccntgggggtttttnccctttnggcttcngnccc

SEQ ID NO: 7261 - DNA, 443 bp, Zea mays
caacaatcagagcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgattcgcctctgcgccgacgcggaggcgctgctggaggcgcactactccgacctgctggcctccttcgacaacccgctggagcacctgt

SEQ ID NO: 7262 - DNA, 326 bp, Glycine max
  misc_feature (2)..(2): n is a, c, g, or t
  misc_feature (5)..(5): n is a, c, g, or t
  misc_feature (144)..(144): n is a, c, g, or t
  misc_feature (190)..(190): n is a, c, g, or t
  unsure (1)..(326): unsure at all n locations
angtnagctcggaattcgctcgaggtattgtcgcagagaaagaaaaccctagctcaccgtttcaagatgcaaatcttcgttaagaccctcactggtaagaccatcactctcgaagtcgagagttcagataccatagacaatgtnaaggccaaaattcaagacaaggaagggatcccaccagatcagcaanggctcatttttgctggcaagcagcttgaggatggacgtacccttgctgattataacatccaaaaggagtccactctccacttggttcttcgtctccgtggtgggatgcaaatctttgttaagaccttgacgggaaa

SEQ ID NO: 7263 - DNA, 854 bp, Glycine max; identical to SEQ ID NO: 7130
  misc_feature (792)..(854): n is a, c, g, or t
  unsure (1)..(854): unsure at all n locations

SEQ ID NO: 7264 - DNA, 379 bp, Glycine max
  misc_feature (6)..(6): n is a, c, g, or t
  unsure (1)..(379): unsure at all n locations
gtcgcntgcacgcgtacgtaagctcgggaattcgggctcgagtgcgtgtgtttgtgaattgttgttgagatctgaatcaaaatcagaaacgataatggctacaccggaccacctcttcaacctccgcaacaacttctacctcggcgcttaccaagccgccatcaacagcagcgacgttgccaacctctcccaagaagataccctcgagcgcgacaccctcgtccaccgctgctacatcgccctcggccagctccagttcgtcatctccgagatccacgacgatgctcccacaccactccaagccgtcaaactcctcgccctctatttctcctctcccgacaccaaggattccgccatcgcgagtctcaaggagtggtcg

SEQ ID NO: 7265 - DNA, 308 bp, Glycine max
  misc_feature (2)..(3): n is a, c, g, or t
  misc_feature (161)..(161): n is a, c, g, or t
  misc_feature (184)..(184): n is a, c, g, or t
  misc_feature (204)..(204): n is a, c, g, or t
  misc_feature (213)..(213): n is a, c, g, or t
  misc_feature (216)..(216): n is a, c, g, or t
  misc_feature (236)..(236): n is a, c, g, or t
  misc_feature (251)..(251): n is a, c, g, or t
  misc_feature (255)..(255): n is a, c, g, or t
  misc_feature (298)..(298): n is a, c, g, or t
  misc_feature (300)..(300): n is a, c, g, or t
  unsure (1)..(308): unsure at all n locations
gnngcagcgtacgtaagctcggaattcggctcgagggagaatgggactgttgtttcttgttgtattaggtgctgcttgggcatgtgatgcaagggaactggctaactctgaaacttctgaactaagcataaaaccggatgtgtgtgcactttgtgaggaanatattaccaaggcacttgattanctacatgaaaacaagactgngacagagancantagtatcctgcacaacactngccaccagcttcctncttncaagcagaagtgcgttgctttggtggactatgatgttcctctntnctctcgga

SEQ ID NO: 7266 - DNA, 1170 bp, Zea mays; identical to SEQ ID NO: 7243

SEQ ID NO: 7267 - DNA, 314 bp, Glycine max
  misc_feature (4)..(6): n is a, c, g, or t
  misc_feature (8)..(8): n is a, c, g, or t
  misc_feature (105)..(105): n is a, c, g, or t
  misc_feature (184)..(184): n is a, c, g, or t
  unsure (1)..(314): unsure at all n locations
catnnncngctcgagagacactctagaatttgcatgcactgttcttcatacaatggcattacgcgagcttcttatgatggggatattgctgctggtatgtcttgncaaggtttcatctgatgttaacatgcaaaaggaagaagatgaagaacttcgcttcctaatcaccctcttatcgtgaganacgggaacagaaggctaatgcaagacatagattgcggaggattgtgcaagacaagtgcagtgcccatcgaggccaaacgtgtgcaacagggttgtggcactgttgtgtgagtgcaatgtgtcccccagaa

SEQ ID NO: 7268 - DNA, 1170 bp, Zea mays; identical to SEQ ID NO: 7243

SEQ ID NO: 7269 - DNA, 405 bp, Glycine max
  misc_feature (151)..(151): n is a, c, g, or t
  misc_feature (167)..(167): n is a, c, g, or t
  misc_feature (171)..(173): n is a, c, g, or t
  misc_feature (183)..(183): n is a, c, g, or t
  misc_feature (190)..(190): n is a, c, g, or t
  misc_feature (192)..(193): n is a, c, g, or t
  misc_feature (198)..(198): n is a, c, g, or t
  misc_feature (203)..(203): n is a, c, g, or t
  misc_feature (212)..(212): n is a, c, g, or t
  misc_feature (217)..(217): n is a, c, g, or t
  misc_feature (219)..(219): n is a, c, g, or t
  misc_feature (222)..(222): n is a, c, g, or t
  misc_feature (226)..(227): n is a, c, g, or t
  misc_feature (233)..(234): n is a, c, g, or t
  misc_feature (247)..(247): n is a, c, g, or t
  misc_feature (280)..(280): n is a, c, g, or t
  misc_feature (292)..(292): n is a, c, g, or t
  misc_feature (355)..(355): n is a, c, g, or t
  misc_feature (376)..(376): n is a, c, g, or t
  unsure (1)..(405): unsure at all n locations
ctcggaattcggctcgagaacataccaaagaatcccctacctatagctattgagagagggtgtgtttacactttggaaatggcagagaaagaagtgagaaacaagcagttggtattaagggactatgtcactggctttcccaaagaatctnaattatatgtcacttncaannntaccatcaanctgaagntnnctccnaaatngattggtcnaaaancnctntatnncagctnntcccacctcaagncctgatgaagaaagctgataaccttagtgtttncagtccttcacncctggcttaccactgtatggatatggagtgctaaggttgtggatctaggacctgatttgaagnagtgactttgtgtggggcatnactggatgggaagagtacactatcaccct

SEQ ID NO: 7270 - DNA, 323 bp, Oryza sativa
  misc_feature (246)..(246): n is a, c, g, or t
  unsure (1)..(323): unsure at all n locations
gaaggatgaccagggttcagtggttctcatgtattcttggtagacatcatcccaagttaaaacacaaaaaaaaagagaatccggacgacttacaattaaacgagaaatcgtactgacatcatcccaagttaaaacacaaaaaaagagaatccggacgacttacaattaaacgagaaatcgtactgaaaatcatgtgccgaaacagcgtaacattttctttgcctcaaggcgaacaatatacactgngaatcccacataactatctgcatacatctgaaggacaggaatagcacaaaatccaccctgtagtgtgataaatctac

SEQ ID NO: 7271 - DNA, 301 bp, Glycine max
  misc_feature (1)..(1): n is a, c, g, or t
  misc_feature (6)..(6): n is a, c, g, or t
  unsure (1)..(301): unsure at all n locations
ncgcangctcgggaattcggctcgagggagtcctccaaagatctatgcttacctcttcctctgcatgatctttctctcttccgccacttcccattctcggttgtggctactgtggcaaaccccccaaaaagcacaagcctggtaaaacaccaaagacacccaaaacacccgttgttaagccaccagtcaccatccctcccattaatgttcctcccgttgttcttccaccaatagtgaagcccccaggtattctccctccaattccattattaacccaccaaccacacagggaagggaggac

SEQ ID NO: 7272 - DNA, 454 bp, Zea mays; identical to SEQ ID NO: 7103

SEQ ID NO: 7273 - DNA, 284 bp, Zea mays
  misc_feature (12)..(12): n is a, c, g, or t
  misc_feature (257)..(257): n is a, c, g, or t
  misc_feature (262)..(262): n is a, c, g, or t
  misc_feature (278)..(278): n is a, c, g, or t
  unsure (1)..(284): unsure at all n locations
attgatgcgcancccactcagatcctaacaccatcaagcagattttagctcagcaggtaacctctccggtgcaatggggaaccactgttaagaatcttatgggcaaggggcttgagaaaagttatgaactcggacctggaaaggttatagcaggtattctcaagaggatcaacaaaggcactagcattgagaacatcggggcttaaacgtctgggatctgaagaactcttgatggaaccaagttacacagcagaagnttganacatgccattattgtngaacgt

SEQ ID NO: 7274 - DNA, 337 bp, Glycine max
  misc_feature (8)..(8): n is a, c, g, or t
  misc_feature (191)..(192): n is a, c, g, or t
  misc_feature (196)..(196): n is a, c, g, or t
  misc_feature (201)..(201): n is a, c, g, or t
  unsure (1)..(337): unsure at all n locations
agtcgcangcacgcgtacgtaagctcggaattcggctcgagcttcatttcttccctcgccgctttgtgctgctgctgctgcaaaacctagggttgagccttttgctcaggttttcagcgcttctttcttacaatggttctacagaacgatattgatttgctgaatcctccagctgagttggagaagagaanncaancttcnaagcgtcttgtgcagtcaccaaactctttcttcatggatgttaagtgccagggctgcttcaacataacaactgtgtttagccactctcagactgttgtggtttgcggaaactgccagactgtgttgtgccaaccaa

SEQ ID NO: 7275 - DNA, 405 bp, Glycine max
  misc_feature (7)..(7): n is a, c, g, or t
  unsure (1)..(405): unsure at all n locations
gtcgcangcacgcgtacgtaagctcgggaattcgggctcgagctctaattcagctttgggagtaacctagttgaagatgccatgggaaacctctttggcaaaaataaaaagcgtgacactgaaagtgccaacaataataaaggaagaggtggaagaatctacactgccgtgaccacaagaggcttaccacctcatttcccaacacaattacctcattcacagcctccaccgctattatatccaactctagaacctccgccaccgccaccgccgccgccgccgccaccggcactaccacaatccatgtccaagaaaccaagttttgcgagagttttcgctaaacaaagctcttcagtcatgaacaacaatcaatctgctgccaagagtatgctttgattcgtgata

SEQ ID NO: 7276 - DNA, 285 bp, Glycine max
  misc_feature (2)..(2): n is a, c, g, or t
  misc_feature (8)..(8): n is a, c, g, or t
  unsure (1)..(285): unsure at all n locations
antcgcangcacgcgtacgtaagctcggaattcggctcgagcaatgccagtgttcccgaaatcgtgggcggcgattctgttatcattcgataacgttggggtgtggaacttgaggtccgagcttgctgagaatcgctacttgggacaacaattgtacatcagtgttctaactcctgagcgttctctgagggacgagtacaacatcccggagtacgcgttgctttgtggcgtagtgaagggtctgccaaagccagagccatatcactgatgttgggccatatgaag

SEQ ID NO: 7277 - DNA, 323 bp, Oryza sativa; identical to SEQ ID NO: 7270
  misc_feature (246)..(246): n is a, c, g, or t
  unsure (1)..(323): unsure at all n locations

SEQ ID NO: 7278 - DNA, 341 bp, Zea mays
gtctctgctactcacctagccgccagtcatgggcatgatcaagatcggaatcaacgggttcggaaggatcggctggctcgtggtcagggtcgtcctgcagagcgaggatgtcgagctcgtctgcgtcaacgaccgcttcatcaccacggattacatgacctacatgttcaagtacgacaccgtgcacggtcaatggaagcacatgcgacattaccctcaaggactccaagacgcttcttgttggcgagaagccggtcaccgtctttggcatcaagaacctccgagagattccgtgatgtgaggctggtgctgtatatgtcgtgcagtccatcggtgtcttc

SEQ ID NO: 7279 - DNA, 235 bp, Zea mays
  misc_feature (122)..(158): n is a, c, g, or t
  unsure (1)..(235): unsure at all n locations
gttttccgtctagcctcggtggacagatcgacgctgcccatgctgataaatggacggtcctgatccattgttcgttgtgttattaatgttgtataattgagcaggacacaacacgtacgttnnnnnnnnnnnnnnnnnnnnnnnnnnnnnnnnnnnnncaggttcatcaagaccgccgcatacggccactttggccgtgacgacgccgacttcacctgcgaggtggtcaagcccc

SEQ ID NO: 7280 - DNA, 326 bp, Zea mays
ctccccttgctggccaaatcgatcgctccccttcaggctccaggctccggagcttgctttacttcagattgcatctttagcgattcgaagtggcaatggtcttctcttgaaaggtggaaaagaagccatgagatcaaacaaagtatcgcataaggttataactggtgccattcctagcaacgtgggtgaaaaattattggccttgttacaagtagagacgaaattgctgatttactaaagcttcatgatgtaattgatcttgtcattccaagaggtagcaataagctggtttcacaaatcaaggcatcaactaagatccctgttct

SEQ ID NO: 7281 - DNA, 323 bp, Zea mays
  misc_feature (12)..(12): n is a, c, g, or t
  misc_feature (20)..(20): n is a, c, g, or t
  misc_feature (65)..(65): n is a, c, g, or t
  misc_feature (101)..(101): n is a, c, g, or t
  misc_feature (144)..(144): n is a, c, g, or t
  misc_feature (202)..(202): n is a, c, g, or t
  misc_feature (204)..(204): n is a, c, g, or t
  misc_feature (207)..(207): n is a, c, g, or t
  misc_feature (227)..(227): n is a, c, g, or t
  misc_feature (244)..(244): n is a, c, g, or t
  misc_feature (270)..(270): n is a, c, g, or t
  misc_feature (276)..(276): n is a, c, g, or t
  misc_feature (310)..(310): n is a, c, g, or t
  unsure (1)..(323): unsure at all n locations
gggatcatcgangggctgangggggcgaacaagcatgcgcgggctacaagggcacggtggtgctncatgcgcaagaacgtgctggaccttcaacgacttcngcgccaccgtcgttgacagcatcagcgagttcctcggcaaggnggtcacctgccagcttcattcagcttccaccctcgtcgacgccaacaacggcaaaccncnggngggtcggggcggaggcgaanctggagcagtggctgangagcctgccgtcgctgacgaccggcnagtccnagttcggcgtcacgttcgatgggaggtggagaanctgagagtaacgg

SEQ ID NO: 7282 - DNA, 374 bp, Glycine max
  misc_feature (27)..(27): n is a, c, g, or t
  misc_feature (80)..(80): n is a, c, g, or t
  unsure (1)..(374): unsure at all n locations
agtgtctgacttgctacagttcaaccngtacgcatgacgaccggtctgaatttccggtcgaccgcactcgttcgactgcnctcttaccaagtcctcctttggttatggttccttagggttttgtgggggggggatggctgcggctgatgtggagtaccgttgcttcgtctgctggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaactgcaaggagctcgacggtcgtaacatcaccg

SEQ ID NO: 7283 - DNA, 318 bp, Glycine max
cgtcgccatgggccttgttatcttttgacagaggaagggctccgggtaagaatgtttcgctcacatgaaggaccgtaaaggcgctgctcgcctgcgcgccttggatttcgctgagcggcacggctacatcaaggtcattgtcaaggacatcatccactatctcttccgtggcgcgcccttcgccaaggtggtcttccgggatccgtatcggtttaagaagcgtacggagctgttcattgccgtctagggcattcacacgggccagtttgtgtattgctttaagaatgcccatctcaacattggcaatgtgcttcctgt

SEQ ID NO: 7284 - DNA, 271 bp, Glycine max
  misc_feature (95)..(95): n is a, c, g, or t
  misc_feature (132)..(132): n is a, c, g, or t
  unsure (1)..(271): unsure at all n locations
gcccttctaaaaccttatctctttgagttatcctcggccatggcgtctctactgctagcatcaccttctccactctccgttcaattgcacaattncacctgtcacctttccttctctcactcccaaactctntcctcaccgctctccacttcctttccttctctctcagcctctgcaaccaccactctcttcccaaccccttctgtgtactgtggcagaagggacaggaaaactgcaaagggaaagcgcttcgctcattcatttggaaatg

SEQ ID NO: 7285 - DNA, 460 bp, Glycine max
gcgacacataacagtggactggattctactcgtttatacctatttataccgacctagccaagaagcacgaccaccactagagaaggaatggcgagcaacggcaagttggtgtgtgtgaccggcgccttcggctacatcgcgtcatggctggtgaagctcctccttcagggcggctacaccgtcaacgccaccgtccgcgacccagttgatccgaagaaaacggaacacttgcgtgcacttgatggagccagtgagagattgcatttcttcaaagcaaacttactagatcagggatcgtttgatgctgtggttgatgggtgtgaatgcgttttccatacagcttctcctttttattatggtatcacagactcacaggccgagttgattgaccctgcattgaatggaacactcaatgttttgggttcctgcaccaaatcttcttctattaaaagggtggtag

SEQ ID NO: 7286 - DNA, 118 bp, Glycine max
cttctgctacaagacgactacagaataccggggcgggtagactacaacaggagtataccactatcataatcctacataactagtctaatcacaaatagtctcttaattcattccatct

SEQ ID NO: 7287 - DNA, 310 bp, Zea mays
  misc_feature (24)..(25): n is a, c, g, or t
  misc_feature (52)..(52): n is a, c, g, or t
  misc_feature (111)..(111): n is a, c, g, or t
  misc_feature (173)..(173): n is a, c, g, or t
  misc_feature (215)..(215): n is a, c, g, or t
  misc_feature (297)..(297): n is a, c, g, or t
  unsure (1)..(310): unsure at all n locations
gttccagcatctttggattacacnncgtgcagtattgacgatggtgctaacnggttgcagattcgcagactcggtgtttgttatcttcttttcatgaccaagtgttgaacnggttttcaggtgaacccagacgacattgtgttcggaggctgggacattagcaacatgaaccnggccgactccatgaccagggccaaggtgctggatattgaccngcagaagcagctcaggccctacatggagtccatggtgccattcccggtatctatgatccggattcatcgggctaacccaggntctcgcgccaaca

SEQ ID NO: 7288 - DNA, 385 bp, Glycine max
  misc_feature (243)..(243): n is a, c, g, or t
  misc_feature (350)..(350): n is a, c, g, or t
  unsure (1)..(385): unsure at all n locations
caaaaaccctaggtagagagctcttcctccctttctcacagcaatggccgccgcagcacgccctctcgtcaccgtgcaggccctcgacggtgacatggcaaccgatgcctccgccaccgttcccatccctgacgtcatgaaggcctctatccgccccgacatcgtcaatttcgtacactcgaacatctccaagaacagccgccagccatacgccgtcagtcgtcgcgctggtcaccagacctncgccgaatcctggggtaccggccgagccgtctcccgtatcccccgtgttcccggcggcggaacccaccgcgccggccaaggagcctttggaaacatgtgccgcggcngacgcatgttcgccccgaccaagatctggcgccgc

SEQ ID NO: 7289 - DNA, 254 bp, Zea mays
  misc_feature (2)..(2): n is a, c, g, or t
  misc_feature (13)..(13): n is a, c, g, or t
  misc_feature (23)..(23): n is a, c, g, or t
  misc_feature (27)..(28): n is a, c, g, or t
  misc_feature (32)..(32): n is a, c, g, or t
  misc_feature (45)..(45): n is a, c, g, or t
  misc_feature (63)..(63): n is a, c, g, or t
  misc_feature (65)..(65): n is a, c, g, or t
  misc_feature (70)..(70): n is a, c, g, or t
  misc_feature (72)..(72): n is a, c, g, or t
  misc_feature (87)..(87): n is a, c, g, or t
  misc_feature (97)..(97): n is a, c, g, or t
  misc_feature (101)..(101): n is a, c, g, or t
  misc_feature (162)..(162): n is a, c, g, or t
  misc_feature (169)..(170): n is a, c, g, or t
  misc_feature (175)..(175): n is a, c, g, or t
  misc_feature (178)..(178): n is a, c, g, or t
  misc_feature (182)..(182): n is a, c, g, or t
  misc_feature (187)..(187): n is a, c, g, or t
  misc_feature (209)..(209): n is a, c, g, or t
  misc_feature (215)..(215): n is a, c, g, or t
  misc_feature (218)..(218): n is a, c, g, or t
  misc_feature (220)..(220): n is a, c, g, or t
  misc_feature (224)..(224): n is a, c, g, or t
  misc_feature (227)..(227): n is a, c, g, or t
  misc_feature (248)..(248): n is a, c, g, or t
  misc_feature (252)..(252): n is a, c, g, or t
  unsure (1)..(254): unsure at all n locations
cnacgttgctgcncgatcccaangcgnnccgngacaccatcgacntctttgtcgagcggtacnangaccnanggatcaccgtggttnctggtgttgnagcnatagggttcatttttggtcctcctatcgctttagccattggcgcaaaatttgtgccttgangaagccnnagaanttnccangcgangtgatctccgaagagtattctntggaanatngnactnacnagatagaaatgcatgtcgganctgnac

SEQ ID NO: 7290 - DNA, 320 bp, Arabidopsis thaliana; identical to SEQ ID NO: 7196

SEQ ID NO: 7291 - DNA, 272 bp, Zea mays
tgcggaatttgctttctgtcgcctacaagaacgtcatcggtgcacgccggcctcttggaggatcgttacctcgatcgagcaaaaggaggagtccaaaggcaacgagtctcaggtcacattgatcaaggagtaccgtcagaagattgagaccgagttggccaagatctgcgaagacatccttgaagttttggacaagcacttgattccttccgctcagaccggtgaatccaaggttttctaccacaagatgaagggtgactaccaccgttact

SEQ ID NO: 7292 - DNA, 168 bp, Zea mays
  misc_feature (37)..(37): n is a, c, g, or t
  misc_feature (155)..(156): n is a, c, g, or t
  misc_feature (158)..(159): n is a, c, g, or t
  unsure (1)..(168): unsure at all n locations
atgtttttttttttttatttaatttaatttttttttntgattttttttttttttttcttttattatttatttagataattagagttttagaatttttttttttttttttttaataagaagagttttattttttttttattagaaaaaagccccgnngnngggcgtaag

SEQ ID NO: 7293 - DNA, 239 bp, Glycine max
  misc_feature (4)..(4): n is a, c, g, or t
  misc_feature (21)..(21): n is a, c, g, or t
  misc_feature (24)..(24): n is a, c, g, or t
  misc_feature (41)..(41): n is a, c, g, or t
  misc_feature (81)..(81): n is a, c, g, or t
  misc_feature (87)..(87): n is a, c, g, or t
  misc_feature (105)..(106): n is a, c, g, or t
  misc_feature (113)..(114): n is a, c, g, or t
  misc_feature (116)..(116): n is a, c, g, or t
  misc_feature (135)..(135): n is a, c, g, or t
  misc_feature (138)..(138): n is a, c, g, or t
  misc_feature (147)..(147): n is a, c, g, or t
  misc_feature (223)..(223): n is a, c, g, or t
  misc_feature (229)..(229): n is a, c, g, or t
  unsure (1)..(239): unsure at all n locations
cgangcacgcgtacgtaagcncgnaattcggctcgagcganagttacctccggtccgggcagcgagtaaaccgcccggccngcgcgngtcgttggatatatgatnnagtgganntngacagagtgtcccattatntcntaatttcgncattttcctccttccttctaataagacttctctctcaccctcggccccaccttcacgtgtgattggaggtgtttgncgcttntgtaataatt

SEQ ID NO: 7294 - DNA, 707 bp, Zea mays
gttcgacgcactttggtggcggtgccgctactctccttcccgagttcctaacttcctaactaggagggcgggcgttgtctgcctgtgtgcttttggcgattcgggggcttgggctcggatctgcgcgtgccttcctccggacccgagcgaggctcgggcgcgaatttggggcggatcagcgcagatctggaggcacatgaggaggaggaggcggaggggtagcgggagcgatgcggtgcttctgcgaagggcttgagccgacctgggaaggtgattctggaggaggtggcggtggctgcggaggcggagggggaggctggaggagggatggaagacgtcgtagcagtcgtggcgtcactctccgcgccgccggcgccggcgtttagccccgccgcggcggggctcacgctgatcgccgcggcggtcgcggacccgatcgccgcggtggtcgtcggagccatggagggggtctccgtgcccgtgactgtgcccccggtcaggacggcgtccgcggtggacgacgacgcgctggcgccgggagaggaagggggagacgcctctttggccgggagcccgtgctcggtggtcagcgactgtagcagcgtggccagcgctgatttcgagggggtcggggctgtgtttcttcggcgcggcagcaggcgcggagggtggtcccatggtgttggaggactcgaccgcgtctgcag

SEQ ID NO: 7295 - DNA, 301 bp, Glycine max
aagctcggaattcggctcgagtgcaatttttgctagtggaagtccatttgatcctgtagaatacaagggcaaagtgtactattctggccaggccaacaatgcttacattttcccgggctttggtctggggttggtaatctcaggagcaatcagagtgcatgatgatatgcttctagcagcttcggaagccttggctaaactagtgtccaacgagaactacgaaaagggcttgatttatccaccattctctaacatcagagaaatttcagctaacatagcagcaagtgtagctggcaaggca

SEQ ID NO: 7296 - DNA, 160 bp, Glycine max
  misc_feature (31)..(31): n is a, c, g, or t
  unsure (1)..(160): unsure at all n locations
tcgcatgcacgcgtacgtaagctcggaattnattccggaccggtacctgacaggcgtaccagctttccctatagtgagtcgtattagagcttggcgtaatcatggtcatagctgtttcctgtgtgaaattgttatccgctcacaattccacacaacatac

SEQ ID NO: 7297 - DNA, 270 bp, Zea mays
ctctgtggattgcatcggattttggcaccaaggagaccaaatggcttgtccgtgctggagttgggctgaaggaggcaccaggcgcagagaaatggaacgatgctgagcggatttctttcatgcggaacaacattcttgagttgtatgagaggcctaactgccccttactgaagacattgatgctgcaaggaaatcctgggctggacaagatatgtgatggattcttccaatacatgccatctctcagagtgttagatctgtctcatacct

SEQ ID NO: 7298 - DNA, 1130 bp, Zea mays; identical to SEQ ID NO: 7122

SEQ ID NO: 7299 - DNA, 293 bp, Glycine max
gacagcaaaaacaatgtaataaagatgagtttgaagaacaacatggtggtgctaaaggtgtgtttgttgcttcttttccttgtgggggttacagctgcacgcatggaactgagcttcttcaaaagtgatcagtcatcaagttatgatgatgatgagtattcaaaaccatgctgtgatctctgcatgtgcacacgctcaatgcctcctcaatgcagctgtgaagatattaggctgaattcatgccactcaaattgtaagagctgtatgtgcacacgctcacagccaggacagtg

SEQ ID NO: 7300 - DNA, 486 bp, Glycine max; identical to SEQ ID NO: 7124

SEQ ID NO: 7301 - DNA, 324 bp, Zea mays
  misc_feature (5)..(5): n is a, c, g, or t
  misc_feature (29)..(29): n is a, c, g, or t
  unsure (1)..(324): unsure at all n locations
acccnaaaaaccggccccagctacgcatnggccgaagcacacaaataaccataaaacatgggcccctggccccctccgttggcacgaaggtaactaaaccttcaaacaccagcccgatgttacaaacgctaaacgcatacatgttgaaccacggggcggaaagagatagaggctgcaccttatacgcaagaacatcctaatgcgaatgttacagctagagcgcatcacacagagcctgccgagacgagtggatagtcggactgcagacaccgataccactgcccattgggcacggccgggcgcttccctcccgcgcctgcggtg

SEQ ID NO: 7302 - DNA, 393 bp, Zea mays; identical to SEQ ID NO: 7121
  misc_feature (34)..(34): n is a, c, g, or t
  unsure (1)..(393): unsure at all n locations

SEQ ID NO: 7303 - DNA, 303 bp, Zea mays
  misc_feature (63)..(63): n is a, c, g, or t
  misc_feature (91)..(91): n is a, c, g, or t
  unsure (1)..(303): unsure at all n locations
cccaagtgctcccttgggtgcgctcgtcgccggtggcagtgagccagtgatgcaccttcatcnccggcttccttactaggatcagcccgtncgatcgatcatggcgtcgtcgagctcggctgctactaccagtggcgacagtcagggcctcaaggctcgagatgcctgcatcgtcggcgtcgcccgcacgcccatcggcgcacttctcgggtcgctgtcgtccctccccgccaccaagctcggctccatcgccatccagggtgctctcaagagggcgaagtcgacccggcgctcgtgcaggag

SEQ ID NO: 7304 - DNA, 284 bp, Zea mays
  misc_feature (48)..(48): n is a, c, g, or t
  misc_feature (52)..(52): n is a, c, g, or t
  misc_feature (71)..(71): n is a, c, g, or t
  misc_feature (74)..(74): n is a, c, g, or t
  misc_feature (76)..(76): n is a, c, g, or t
  misc_feature (97)..(97): n is a, c, g, or t
  misc_feature (144)..(144): n is a, c, g, or t
  misc_feature (157)..(157): n is a, c, g, or t
  misc_feature (211)..(211): n is a, c, g, or t
  misc_feature (234)..(234): n is a, c, g, or t
  misc_feature (236)..(236): n is a, c, g, or t
  misc_feature (247)..(248): n is a, c, g, or t
  misc_feature (268)..(268): n is a, c, g, or t
  misc_feature (271)..(271): n is a, c, g, or t
  misc_feature (282)..(282): n is a, c, g, or t
  unsure (1)..(284): unsure at all n locations
gaacccctctccaatggcgccgtctaccagtcggtgcctgagtcctangtgntcccggagcaccagaggcntangnactcgccgccgtcttccgcgncggcgatacctgtagttgacctcggcggcgatgatcccgacaggacngcggaacagatcntcgccgcggggaaagagttcggtttctttcaggtgatcaaccacggcgtggcgnaagacgtgatggcctccatgatntngcgccgcggannagttcttcaggctcccgacnganagaagatggcnca

SEQ ID NO: 7305 - DNA, 311 bp, Zea mays
  misc_feature (78)..(78): n is a, c, g, or t
  misc_feature (93)..(93): n is a, c, g, or t
  misc_feature (97)..(97): n is a, c, g, or t
  misc_feature (213)..(213): n is a, c, g, or t
  misc_feature (262)..(262): n is a, c, g, or t
  misc_feature (276)..(276): n is a, c, g, or t
  misc_feature (297)..(297): n is a, c, g, or t
  unsure (1)..(311): unsure at all n locations
atcggctgcgcttctcgcgctaacgagtcggtaagccgcagaactgccttcacaagaacagcgtcacttccacttgangagttgaaccatganccanccgtttcttcactggggcggcaacgcaaggagtgttccaagcgttctctgaatgaggggctgttacggagatgggtagagacggcgttggcaagtatcgccgctctggcccacgcnagccgctccgcgctcggcacggctcgtagacggaagcggcggccagganatacgctcgcaganatcctcttgcgccactccganatccatgagcgttc

SEQ ID NO: 7306 - DNA, 249 bp, Zea mays
  misc_feature (59)..(59): n is a, c, g, or t
  misc_feature (223)..(223): n is a, c, g, or t
  misc_feature (233)..(233): n is a, c, g, or t
  unsure (1)..(249): unsure at all n locations
tcgggttaatgagcgtacctgtgatgggcatcgcaaccgagtctaaagcaacaactganagcgtatacagtgctgccttggctctgggaattgcgaaccaactcacgaacatactccgggatgttggagaggatgctagaagaggaaggatatatttaccacaagatgagcttgcacaggcagggctctctgatgaggacatcttcaaaggggtcgtcacgancgtggagaancttcatgaagaggcag

SEQ ID NO: 7307 - DNA, 1548 bp, Oryza sativa
atggcggcgaccatggcgtccaacgccgcggctgcggcggcggtgtccctggaccaggccgtggcggcgtcggcggcgttctcgtcgcggaagcagctgcggctgcccgccgcggcgcgcggggggatgcgggtgcgggtgcgggcgcgggggcggcgggaggcggtggtggtggcgtccgcgtcgtcgtcgtcggtggcagcgccggcggcgaaggcggaggagatcgtgctccagcccatcagggagatctccggggcggttcagctgccagggtccaagtcgctctccaacaggatcctcctcctctccgccctctccgagggcacaacagtggtggacaacttgctgaacagtgaggatgttcactacatgcttgaggccctgaaagccctcgggctctctgtggaagcagataaagttgcaaaaagagctgtagtcgttggctgtggtggcaagtttcctgttgagaaggatgcgaaagaggaagtgcaactcttcttggggaacgctggaatcgcaatgcgatccttgacagcagccgtgactgctgctggtggaaatgcaacttatgtgcttgatggagtgccacgaatgagggagagaccgattggtgacttggttgtcgggttgaaacaacttggtgcggatgtcgactgtttccttggcactgaatgcccacctgttcgtgtcaagggaattggaggacttcctggtggcaaggttaagctctctggttccatcagcagtcagtacttgagtgccttgctgatggctgctcctttggcccttggggatgtggagatcgaaatcattgacaaactaatctccattccttacgttgaaatgacattgagattgatggagcgttttggtgtgaaggcagagcattctgatagttgggacagattctatattaagggagggcagaagtacaaatctcctggaaatgcctatgttgaaggtgatgcctcaagcgcgagctatttcttggctggtgctgcaatcactggaggcactgtgacagttcaaggttgtggtacgaccagtttgcagggtgatgtcaaatttgctgaggtacttgagatgatgggagcaaaggttacatggactgacaccagtgtaaccgtaactggtccaccacgtgagccttatgggaagaaacacctgaaagctgttgatgtcaacatgaacaaaatgcctgatgttgccatgacccttgccgttgttgcactcttcgctgatggtccaactgctatcagagatgtggcttcctggagagtaaaggaaaccgaaaggatggttgcaattcggaccgagctaacaaagctgggagcatcggttgaagaaggtcctgactactgcatcatcaccccaccggagaagctgaacatcacggcaatcgacacctacgatgatcacaggatggccatggccttctccctcgctgcctgcgccgacgtgcccgtgacgatcagggaccctggttgcacccgcaagaccttccccaactacttcgacgttctaagcactttcgtcaggaactga

SEQ ID NO: 7308 - DNA, 384 bp, Arabidopsis thaliana
gctctctgagcaagctgagcgttatgaagaaatggtggaatcaatgaaaagtgttgcgaaattgaatgttgatctgacggtggaagagaggaacttactctccttgaaccaatcacgttcttgtaacccacagagagtaagttcctctcttcgattgaacaaaaggaagcagtgaaagggaatgatgttaatgtaaagaggatcaaagagtatatggagaaggttgagttagagctttctaacatatgcattgatattatgtctgtcttagatgagcatctcattccttcggcttccgagggtgaatctactgtcttcttcaacaagatgaaaggtgactattaccgctatcttgctgagttcaaatcagggaacgagaggaaa

SEQ ID NO: 7309 - DNA, 1577 bp, Zea mays
ctcgaagcttcgagcacgccacaacccaacggcgcgcgggcggcgggcccgtgagcgtgcagtgctgagtacacacgcacgccgagcggcgccactccgggttagcagcaacaatactgtgggattatatgagatgagaaggagactactagactagcagccgtatcactcactacccgctgcccgcgcccgatcgggcgcactgccctgtggtgtactggtgtgtcacgcccctcgtcactcaccccgtcacccgcaaccccatcttctattcttcccgacggcgctcctggcagcaggaacaagatgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaggaggccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaatcgcaagctatctgcaattcgtgccttcaaccctcagctttggagaggcattcatcagctgtaatggctgcttgccgtataaaaaaaggatggttcttgcctgttatattgtgttcagtgcatagccttgctccgtatgtccgtcgtatatataatcccttgcgtgtagtaagcgatgaactgaatgcatccagaatatcatgtcatgataaacttgaatatagtttcatggttgttatttcagactgaaaataaaatcagtcttctgttccggtt

SEQ ID NO: 7310 - DNA, 755 bp, Zea mays
cggagccgctcgagtcgctacaccacgaggtcgagctcgccgtcgtcatctcccggcgtgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatgatgcaataagcaagaaagtaatggtgaatacaaagtgcagtactcgtcctcgaccttgaatcgcattactggacctggagccattgcagatagctcttgagccttaccttgatttaatttacctgggttttgagagactatctatgaatatgctaactcgttcgtaaagtatctttttgtcccaattttgattgatggagctttaagcttgcttttctgtatgcaataaaaaaacttatcacatttttctttc

SEQ ID NO: 7311 - DNA, 706 bp, Zea mays
aaacccgtcctctgtccgtcctaccaccacagctcaccgcggtttggctttctcccctcttccgcacccgcttctcgctccggattccctctgctctttccctaacgaaggtagccatggcggggagaggtaaggcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgctgaggttcttgagctggccggcaatgcggcacgtgacaacaagaagacccgcatcgtaccgcgccacatccagctcgccgtccgcaacgacgaagagctctcccgcttgctgggcacggtgaccatcgctagcggtggtgtcatgcccaacatccataacctgcttctcccgaagaaggccggcggcggcagcgccaaggctgcggctggtgacgaggactaagtccttgactacgcctggtggcacgtcccaggatgctgccgtatcaacttgtgtctgtgtagtacgttaggtgttcgttgtagctgggtatgtgggttgctgtaacactgctaaactaagttactcttgtgcttgctaaggattaagttctgtatttgttgctataaaaggtgcatcctttg

SEQ ID NO: 7312 - DNA, 1192 bp, Zea mays
ccccgatggcgacgacggcgacgaaccggcgggtgatcctcaaggagtacgtggagggatatcctcgcgaggagcacatggagctgctccagggcgccgaggttcccctccgcctgacgggcgccgagccggccgggtccgtcctcgtcaggaacctctacctctcctgcgacccctacatgcggcccaagatgtcgcgcccgctgcgggagtcctacacggccgccttcgtcccgggcgacaccatcacaggctacggcgtcgcgcgcgtggtcgactcctccgacccgcgcctcgcgcccggggacctcgtctggggcatcaccggctgggaggactacagcgtcgtgacgccgcccgccaccaggctcctctccaagatctcccaccacggggtcggggagggggcgggcgtgccgctgtcctactacaccggcatcctcggcatgccggggctcaccgcgtacgtgggcttccacgagatctgcgcgccgaagaagggcgagaccgtgttcgtgtccgccgcgtccggcgccgtcggccagctggtgggccagttcgccaggctcgccggctgccacgtcgtcggcagcgccgggtcccgggagaaggtggagctgctcaagaccaggttcggcttccacgacgccttcaactacaaggaggagcccgacctcggcgccgcgctcaagcgctgcttccccgacggcatcgacatctacttcgagaacgtcggcggcgccatgctcgacgccgtcctgctcaacatgcgcgtgcacggacggatcgccgtctgcgggctcatctcgcagtacaacctggcggacggggagaaggacgccgtgcgcaacctcgccgccgtcatctccaagcgcctccgcctgcaggggttcatcgagcccgaccacaagcacctctacccgcagtacgaggcgtgggtgctgccgtacatcagggacggcacgctcgcctacgtcgaggacgtcgccgaggggctcgagagcgcgcccaaggcgctcataggactcttccacggtcgcaacgtcggaaagcagctcgtccgcgtcgccgacgacgagtgagacgcgcctcacttcgattggaccagacgatccatgtgtcactgttgctatgtttcgattccccattttcattttaataattaattgtgccaatggatgcttttgttcgg

SEQ ID NO: 7313 - DNA, 1333 bp, Zea mays
gcgcgcgggagcagcagctggttcgtcgtgcccgcgcgctctttgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagttcgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctggtcccaaccaagatccacgacaggtccccgatattcctcggaagctacgacgacgtggaggagatcaaagcgttgtacgccgagcaggcgaagtcgagctcggcttcatcctaagtgagggtgtaaatcgacttttcctggcttaatttgttgctgttacctgatccagacattccgttttcgtttcccttggtgtcgtcgtaagtgtgacattcagtgcaatatgtatagcaactaagggactccgtaaaagttacgtacgtacatacat

SEQ ID NO: 7314 - DNA, 1959 bp, Zea mays
gagacaggagagagagagagagagatatagaggggaagacagagagagagatagatgtggtaactcaagaactgttcttatgcatgcggcagccataagcattgctactagggtttcatgcggggcgaagcagctggtctctgccgtctgaacgccgccggaatctgcgaggcctccccgagctgcgtgcgtcgtcagataaggcagccgccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggtacgccgtacgcgcatggcatgaatcaatatcaccttcgtcaagaacttgcgagcaaataaacacggcgccgtggagccacatttgtgtgtgcagagctagcagtgcaacactgtccctttcgtctctctgttctttttaaccagttaagaagtagcatttgctgcatccataaagttttgtttgccttttttttgagatgaaggctttcattcgctacagagacctagctgtaggttccatgatagttcaaggggacaactttggtggtttccctctgaacctcttgcagttctggtgctgtagcagtagttggttactggcctctgaaacgtgaagctgccgcgtgaatcttctgcaggaactgagatggcgcagctagtgtgcggaggatgccacaccctcctcatgtacatacgcggcgcgacgagcgtgcagtgttcttgctgccacactgtgaacctggctatggaaggtaaatcctgtgacttcgattcctgtacgaaagaagaagaagaagaaaaaaaaatcctgctttctgtatattgtgtggtctggaaagctcagcaaccttccaatagcattttaacgtcgtagaattggcctatcttggagtcgtaatcgttgaaattggctattatccagagagatggaaaagcttgacagggatgtcctagagtcactggactggagctgaatgaatatctcgtagagatgcttcagtgtgccgagcacagcatttactggaactttcctacaaggaaggattttagtcccatgaccatgaccacccgttgaattcatcaagttgcgaactttgtcaaaaagaaagggaaaaataaacatcacgttcagagattgtgtatttgtccagggttcagaaatcaagtgctctgctcattcctaacatctccagtgacgaacggtcttcttgttttttttcttcttcttccgtcgcagcaaatcaagtcgcgcatgtgaactgcgggaactgccgcatgctgctcatgtaccagtacggggctcggtccgtgaagtgcgcggtctgcagttttgtgacatcggttggagtaagtactcaaagcatcctttttcagaaaaggatgcaattaacaaataatgtttgttgttgtagaagactaccatcatttcgctgctattcttactgtaaaacaacttgtgtttctcatgagaaacagaaaactaaccgccgagtttcactctactcagacctcacctggtgcagagcagaagcccagcagctgagctgatagtgtccctgaaagtgctgtgagaccacctatgaaaaggatgctttgagtgcacatgtatagagttcttccctgaagcgattctttcactttcttttcttttgttttcttttcttttttggttcctcctcaccatctccaccccacccgtccacttctgcgttccttcgatggatctggcgagcccgcggaataaatgagagtttttggatatatagctagggcttaacctcgtcgacttgtctgtaaaatcgaatgagacacatatataaacctatgttgttttccttgtttc

SEQ ID NO: 7315 - DNA, 568 bp, Zea mays
tgcagatccccaaggcgggcaagatctacgccttcaacgagggcaactacgcgctctgggacgacaagctgaagctgtacatggacagcctcaaggagcccggcgactcggggaagccctactccgcgcggtacataggcagcctcgtcggcgacttccaccgcactcttctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattgggagcgtggaggaagtggacaaggtggagaaattcctggcttgaatgccagagcctctctcatcagatggactcccgaagacatcaagtttagggagggaatatgcatgtactctctctttcccaccccaaataagtcttcttcatctcatatttcgataaatcaaacaatctcaattttgatctaatatatatacacacacaacattagt

SEQ ID NO: 7316 - DNA, 858 bp, Zea mays
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgcaaaatggttgtgctcatctgaaaagctacttactct

SEQ ID NO: 7317 - DNA, 1155 bp, Zea mays
cgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggaatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtattctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccggccggccgcgccaggagctgggcaccgttccaattctgttcctccccatgacgccctgttctgtttccgtgtggccaggactccgctcgctcgctgctgttttctacttcggaccaaagtgtgacatatctttgctttctgtattgtatgtaggaatgcatcatgtaaggagaatttggaatacaattgcgtgagttttt

SEQ ID NO: 7318 - DNA, 1965 bp, Zea mays
atcgccggctgacactcacaagaacctgcctccctcggtctggatcgctatctcttttctagcggctccagagggagggaaagctagcgcacagccgagagaagaaagcagagagggagggagaacaaagagagagagaaaaaaaaaaccagagaggttgagcaagaaccgaggcggatccgccttttgtccctcctgcccgagggctagcctgccgccgcccccgcgagagatcgagaggaggcgctgttcagttcaggtgaaattttgccttgttctgggtggggtctctcgggctctctgtggtgtttggtggtgtaaattggagtgggatttagaggtagttaggtctcgtctgctaggataggtgcggtggtctcgttaatttgtgggctccggaggtcaatttgttcacgatcccggtcctgttcgcggttcagttcaggagcgagtgttcctgagcccaatctaattcgtccataaagtcgatcccttaggtcgaggacaataacctgtttgcagctggttccaggtttcacttgcaaaagatgcgccttgatatctcctccaatcccatgttcatcttatatgatttgatttctagcgacgacaagaatttgtgttcagagagagagagggggcgggggagagagagagaaatcctttaataattgttacagtgctctcggaatctttatcttgttctgagtgagatgcccaaaaaggcaaagggaaatctaacctttcttccagtcctgtgattccttcctacaggggggtgagaagccgtgggggaagagatgatgcgggagacgtacatggacgtgctgccgccggtggaccacatagccgcctcacggagcggcggctggttcccgggcgcggcgcgtctctggacggcggcggagaacaagcagttcgagcgggcgctggccgggctcgacctctgccgcccggactgggagaaggtggcgcgggccatcccgggccggacggtgcgcgaggtcgtcagccacttcaagagcctccaggtcgacgtccagcagatcgagagcggcctggtgcccatgccggtctacggcgccggggccggctcgttcaccctgcagtgggacggctgctacggccccgcggactcgaggcacaacggctaccgcttcggaagcggaggctgcgggaggcggcaccacggccgcaccccggagcaggaccggaagaagggcgtgccgtggacggaggaggagcacaggctgttcctcttaggcctgaagaaatacggcaagggggactggaggaacatatcgcgcaactacgtccagacgcggacgcccacgcaggtggccagccacgcgcagaagtacttcatcaggctcaactccggcggcaaggacaagaggaggtccagcatccacgacatcaccacggtgaacctgacggacgacgagcgggcgccctcgccgtcgcggtcctctctgatcaccaccaccagccagccaaacgcgccggctccggccgcagcggtgataggcgggcccttctcgtcggcggcggcggccgaggccaagcagcaccagcacggcgctgggaacctgccaccgaaccggacctccgtggtgccggctgtttacaggatggacgattcgcaggaccacggcctgcagtgtggccctctgcgtcatcaactggtcgccagccaccacagcgttctgttttaggcgcaagcgcaatcccactttgaggcgcgccatggtcatggatccatccatcaggtgttgtctagtgtgtgtgtgtacgatgcgtgtgttctttgctgtagcttcagcgcctgtatcgaagtgattagccttttggggagggggggcgtaacggaaaggggatcttcggttccacggtggtccaggtccacaatttgttgttggtgatgccgagaacgtaacaaaaaaaaggacgccaagaattctgagt

SEQ ID NO: 7319 - DNA, 1150 bp, Zea mays
gtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 7320 - DNA, 1463 bp, Zea mays
gagaaagataggagtcaattaatttgcctgttctgcttgctgctgaccttgtgagtgagccgccggtcttccccttcctcgccgaggggaaataataaggcagccacagccagggccgccccgaggaagaagatgagcggaggaggcgtggacggagctccggtcgccgagttccggcagacggtgacgcacggcggccggttcctgcagtacaacatcttcggcaacctgttcgagatcacgcacaagtaccagccccccatcatgcccatcggccgcggcgcctacgggatcgtctgctcggtgatgaactccgagacgaaggagatggtggccatcaagaagatcgccaacgccttcgacaaccacatggacgccaagcgcacgctccgggagatcaagctgctgaggcacctcgaccacgagaacatcatcggcatcagggacgtgatcccgccgcccgtcccgcaggcgttcaacgacgtgtacatcgggacggagctgatggacacggacctgcaccacatcatccggtccaaccaggagctctcggaggagcactcccagtacttcatgtaccagatcctccgcgggctcaagtacatccactccgccaacgtgatccaccgcgacctcaagcccagcaacctgctggtgaacgccaactgcgacctcaagatctgcgacttcgggctggcgcgcccgtcctccgagagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataaccgaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtggtttgtaaatagaagatcgagccggccgccggtgttattagactgaacgttgcatttgtttgttcgttgacgttcgcgctcgcaggtttcaggctgtgtagtctgctgcaggtttcaggtgttcgtgtaatgagctgtaccaagaat

SEQ ID NO: 7321 - DNA, 1140 bp, Zea mays
cgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacatgcctagaagctagtacctagtgtttgctgctgtctaatgacattatgcaatgtgatctggaccctggtttcttgggtgcgacgcttgtagcagccgtcttatgattatttgtcgggaaaatttgggggctccccatatgagatgctgccgggcaagacctcgccatcccccacctcgtttcaggcgggggacgctggagcctggtccggttgggttgggaagccccttaaactgttgtcgcttgcattttaaccttttcatcgccgttcagtggtcctaaatc

SEQ ID NO: 7322 - DNA, 662 bp, Zea mays
agctcatcaacgccacctactacgtgcgcgtgccgccatgcctcctcctcctccgcacgtcgtcgtcctcgtcgccgccgcccaccctcgccgtcgcgccgctcaagctcgtcctgcgcaccatcgtcatcatgttcacaacgctcgtcgccatgctggtgcccttcttcaacgccgtgctgggcctcatcggcgcgctcggcttctggccgctctccgtctacttccccgtcagcatgcacatggcaaggctcaacatccgacgcggagagatccgctggtggatgctgcaggccatgagcttcgtctgcctcctcatctccgtcgcagccagcatcggatccgtgcacgacatcgtgcacaacctcaaggccgccgcgccattcaacactgcaaactgattaataaacatgcatttactagtatatatacggatcggatcggaggagtgatgggttaattagtttcttaattagctttggctactatatctatcagtatcagagtcagaggagcagagggccggccacatgcatggcctttttgtgtttcttgattatatatctggcaaatttgatctgtcgagcagattttcatgcatgcatgcatgctgctaattcggacgtacgttgaactagtaataatattattatttgtaatgt

SEQ ID NO: 7323 - DNA, 2619 bp, Zea mays
gctccctcctccaccaccttccagtcctgtccagtgccgccgccttgccctgccctcccctcccttcccccgattaccctcgcggttgacctcgccaatccggtcccgcctccgtataaatccgcccttctcgcccccgctccgaccacaaaccctagcggcgcgccccggcatgggctagggttcccgcggcgatggagtgggacagcgattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgcaagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatg

SEQ ID NO: 7324 - DNA, 1523 bp, Zea mays
caactcggagtcggagattcccctcccagccgtcgaaagtcgaaaccctagccccgcctcaccgccggcggtggtggcagcctcagcaccggcacacagcccgccgtacctctcctcgtacgctcccttccggtgtgccgtcgccccctcgaccggtccatcgttcgtcggctcggtagccgccggatcggatcgggatcggccggcgccatgtccaaggccagggtctacaccgacgtcaacgtgctgcgccccaaggagtactgggactacgaggcgctcaccgttcaatggggtgagcaggataactatgaagttgttaggaaagttgggagagggaaatacagtgaagtctttgagggtattaatgttaacaataatgagaaatgcatcattaagatcctcaagcctgtgaagaaaaagaagatcaaaagagaaattaaaattcttcagaatctttatggaggccctaacattgtgaagctgcttgatattgttagagatcagcattcaaaaacaccaagcttgatctttgagtatgtcaacaacacagatttcaaagtgttgtacccgacactaacagattatgacattcgatattacatctatgagttactcaaggcattagattactgccattcacaaggtattatgcaccgagatgtgaagccccacaatgttatgatagatcatgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcaggaaaccctggacaaagtttattaatgcagacaaccaacacctagtgtctcatgaggccatagatttcctcgacaagcttttgcgttatgatcatcaggacaggcttactgcacgtgaagctatgacacacccatacttccaacaagtgagggctgcagagaacagcaggacgcgggcatgagaggccaaagaccaaagaggcaaagactggtgctaaccgtggatcagatcatctgctcttggtggagccatgctcttaccagtgatgaatagtggtttgggggtttacttggcaaaaacaaacagtagctatggcgcctgttgtacccttaaccgcgtcgagacgtgactgaattactcaggtcatcggcttgtgggacgtgattgcgaacgagattattcatgtaagatgtttgtcataaaaggtcgtcgttggctgattgtgctgtttgtattgttgagctagtaaagaatatccaaaatttgtttggactt

SEQ ID NO: 7325 - DNA, 1765 bp, Zea mays
catctcatctcttgctcctcgtccgtagttgcagttgcagtgtcctcggccgcctctagtcctagccgtttactccttcctttcaccgcatcaagcagagagcaagcgaggcaagagccatgggcgcctttctgctcttcgtctgtctcctggcgccggtcgtcgtgctcgcctgcgccgtccgcggcaggaagcggcgggcgtcctccgcggcggcgggcggcaaggcgctgccgctgccgcccgggtcgatggggtggccgtacgtgggcgagacgttccagctctactcgtccaagaaccccaacgtgttcttcgcccggaagcagaaccggtacgggccaatcttcaagacgcacatcctgggctgcccctgcgtgatggtgtccagcccggaggcggcgcgcttcgtgctcgtcacgcaggcccacctcttcaagcccaccttcccggcgagcaaggagcgcatgctggggccgcaggccatcttcttccagcagggcgactaccacgcccacctccgccgcctcgtctcccgggctttctcccccgaggccatccgcggctccgtgccggccatcgaggccatcgcgctgcgctcgctcgagtcctgggacggccgcctcgtcaacaccttccaagagatgaagctgtacgcgctgaatgtggcattgctgtccatcttcggcgaggaagagatgcggtacatagaggagctgaagcagtgctacctgaccctggagaaggggtacaactcgatgcccgtgaacctgccgggcaccctgttccacaaggccatgaaggcccgcaagcgcctgggcgccgtcgtggcccacatcatcgaggcccggcgcgagggcgagcggcagcgcgggagcgacctcctggcctccttcctggacgaccgcgaggcgctcaccgacgcccagatcgccgacaacgtgatcggcgtcatcttcgccgcccgcgacaccaccgccagcgtgctcacctggatggtcaagttcctcggcgaccaccccgccgtcctcaaggccgtcatcgaggagcagcaggagatcgcgcggtccaaaggctcctccggcgagcccctgacgtgggcggacaccaggcggatgcgcacgacgagccgtgtgatccaggagacgatgcgggtggcgtccatcctgtccttcaccttccgggaggccgtggaggacgtggagtaccaagggtacctgatccccaagggctggaaggtgatgcccctgttccggaacatccaccacagccccgaccacttcccctgcccggagaagttcgacccctcccgattcgaggttgctcccaagcccaacacgttcctgccgttcggcaacgggacccactcgtgcccgggcaacgagctcgccaagctggagatgctcgtgctcttccaccacctcgccaccaagtacaggtggtccacctccaagtccgagagcggcgtgcagttcggccccttcgcgctgccgctcaacggcctgcccatgaccttcgtccgcaaggactgatgagccgccgacagatgtgtggatcgtggacggagccacaccaaaaccacggcaggccgacggaaccaaaccaaagccaacaacaaacaggcggatggatatggtatggcggtatatgctagctagtactactataggagccgcgaaaaccgcttccgggatttggcgttgcggcggtcgccatcggacgggacggggacaggcatcaggcaagcatgggatgatcacagagg

SEQ ID NO: 7326 - DNA, 783 bp, Zea mays
ggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7327 - DNA, 1457 bp, Zea mays
gaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccgcgagtggagtcactcatccaggaggttaagaaggtgactaacaagcccgttgctgttggcttcggcatatccaagccagagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgaccgaccaataaaaataagccaagtggaagtgaagcttagctgtatatacaccgtacgtcgtcgtcgtcgttccggatcgatctcggccggctagctagcagaacgtgtacgtagtagtatgtaatgcatggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgt

SEQ ID NO: 7328 - DNA, 1085 bp, Zea mays
ataggataaagcttccaggaaatgcaatgctaggtgaaggaaaaccagagaaccagaaccatgccataattttcacacgaggaacattatatggaggagactttgaaaatgaggaatttgttgcaagagtttctgaagaaacatgatggtgtgagatatccatcaatacttggtgtaagagaacacatcttcaccggaagcgtgtcttctcttgcatggttcatgtcaaaccaagaaacaagttttgtgaccattggacaacgtgtacttgccaatcctttgagagttcgatttcattatgggcatcctgatatctttgatcgacttttccacctcacacgtggaggtgtaagcaaagcttctaagattatcaatcttagtgaagacatatttgctggatttaattcaacactgcgtgaaggaaatgttacacatcatgaatacatgcaagttggcaagggcagagatgttggtctcaaccagatctcactatttgaagcaaaaatagcaaatggtaatggtgaacagacgctgagccgtgacgtgtaccgtcttggacatcgttttgactttttcagaatgttgtcctgctactatactactattggtttttacttcagcacaatgataacagtttggaccgtttatgtattcctctacgggcgcctgtatcttgtcctaagtggccttgatgaagcattagccactggaaagaggtttatacacaacgagcctctccaggttgctctagcttcacagtcttttgtgcagcttgggttcttgatggcgctgcctatgatgatggaaattggtctagagagaggattcagaactgcattgagtgactttgtacttatgcagctccagttagcatctgtgttcttcacattctctcttgggaccaaaactcactactacggaaccacactgctacatggaggagctgaatatagagctacagggcgtggatttgtggtgttccatgccaagtttgctgagaattatcgattgtattcgcgaagccattttgtgaagggcattgaactgatgattttgcttattgtgtatgaaatatttgggcagtc

SEQ ID NO: 7329 - DNA, 1034 bp, Zea mays
cagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaagcccatcccgacgcacgccgtcgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcgccacaccatcgtctccgctctggatgaatggattcaaacccgtcgtcgtttgcttttgctcctcgcgccacgttcaattaatgcttgtgtatgcatgtatgtgccagtatgatgtgccgttgccctggtccattcatttccctttcttttttcggggtgaaatagatgtaaagatctcgtcttgcctgccgt

SEQ ID NO: 7330 - DNA, 3056 bp, Zea mays
ggggccgtcgcagaattcgcgccaccgcccgcgatggcttcgtcctcgaaggcctccgattcctcccaacgatccaagcggtcggatcaggggatgggcaaggacgccgctgccgcctctgttgtcccgatccacgcgaacctgacgcagctgatacggcaagtccaatcggggcgcctcgcgtacatcaaggagaaattggaggtgaacaggaaaacgctgcagaggcactcctgctcgctgttcgacgtggcagcggcggcggaggtggcgtcgaggggcaccgatggcggcaacgcgctgtcacagcgcgcggcggagagacagtgtgggtcagacctggcaaacgggataggggagagggacgtggtttccgttcaggaggagaacctggctaccggtacgctcgcgctctccagctcgggcgctaccgcgcagcggacaattgtgcggttcgtgaagctgccgctggttgagaagatccctccgtacaccacttggatcttcctggacaaaaaccaaagaatggctgacgatcagtcagttgttggtaggagaaggatatactatgatacagttggaaacgaggctctgatctgcagtgacagtgatgaagaaattccagaaccagaggaagagaaacactttttcacaaagggagaagatcatttgatatggagagctactcaagaccatgggttaaaccaagaggttgttaatgtcctttgccagtttattggtgcaaccccatcagaaattgaggaaagatctgaagtcctatttgagaaaaatgagaagcactcaggatcttcagataagatagagagccgactttctcttgacaaaactatggatgccgttctggattcttttgataatctcttctgccgcagatgcttggtttttgattgccgccttcatggttgttcacagaatttggtatttccatgtgagaagcaaccctacagctttgaccctgatgaaaacaagaagccatgtggtcatttgtgctaccttcgatggagagaaggatttaaagagatgcatgatgatggtcttgctggtggtgcaacatatactatggaatcgggaactgcctcacagagagttgatgttaatgttatgtatgaatcagaagattcaaaccgacagaaaggcaacattaggtccatgacactagttggaaccagtggatcaaaaataatttcttctgtcagtgcggaagaaagcactactactccttcagcagatatctctgaaacagagaatgtatcctctgatttgcctcccagtagtttaaggaaacacaagatttcaaaacatggacctaggtacagggagcattctcctggcaaaaggcagaaggttttcacttctgacatttcttttgaaggcaatataatgaataaactttccattccggagattcgtgacacaagactagagtccagagaatctggtggtgataaactacgaattcttgacgagtccactaagaagacttcaaggaaagatatgtgtggggaaagcccagctactaccatggaaaatgtgggaagacagagtaataaagtgtcttcaacaaagaatttcttggagtccactctttcttgttggagtgccttagagcgagatctatacttgaagggcatagagatatttggaaagaacagctgtctcatcgccagaaacttactatctggtcttaagacctgcatagaagtggcaaactacatgtataacaatggtccagcgatggcgaagagacctctcttgaataaatccatctcaggcgactttgcagaaaatgaacaagactacatggagcaagacatggctgccagaacaagaatctatcgtcggaggggccgcaatcgaaagctgaaatatacttggaaatctgcagggcatccaactgttagaaaaagaactgatgacgggaagcaatgttacacacaatatagcccatgtgcgtgccagcaaatgtgtggtaaagattgcccctgtgcggacaagggaacttgctgtgagaagtactgtgggtgttcgaagagctgcaaaaacaagtttagaggctgtcattgtgcaaaaagccaatgcagaagcagacagtgcccctgttttgcagccagtcgtgaatgtgatccagatgtttgtaggaattgctgggtgagctgtggagatggttcactaggtgagccacttgcaagaggtgatggttatcagtgtggaaatatgaagctccttttgaaacaacagcaaaggattttgttaggaagatctgatgttgcaggttggggtgcattcattaagaatcctgtaaataaaaatgattatcttggagaatatactggtgaattgatctctcacaaggaagcagacaaacgcggcaaaatttatgaccgggcaaactcatcttttctgttcgatttaaatgaccagtatgtgttggatgcttatcgcaagggggacaaattgaagttcgcaaatcactcatctaaccccaactgctatgcaaaggtgatgctggtggctggcgaccatcgggttggtatatatgcgaaggagcatattgaggctagcgaggaactcttttatgattatcgttatggacctgaccaggctccagcttgggctaggagacccgaaggatcaaagaaggacgaggcatccgtctctcaccgtcgagcacacaaagtggctcgatagctgaagagtcgctccggatgatacaatatgcagtaaacttaatacttaatacatgattcagtcctagttcattggtagataaacatgctatatactatccattagtaaataaactctcattcatcgagttggagaataaatgcgtataaacatatgtggacctcaggtcgggaaggtggcaaccttgttagtttgagcaccaacaggttctcaaacttgagtggctattgctagagtatcaaataatggctgcgactatagccttgtttgtatattttcttggtgagatgaaataatttgtcaaacactcaaatgtacactttattcctgaaagtatttgatgattc

SEQ ID NO: 7331 - DNA, 3608 bp, Zea mays
ccttccagaaacctccaggatccgactccaatcgaatcgccaaagcagacaggggcgctcgcgggggcgccgagctcgacggggcgagatggccgggaacgactggatcaacagctacctggaggctattctggacgctggcggggccgcgggagatctctcggcagccgcaggcagcggggacggccgcgacgggacggccgtggagaagcgggataagtcgtcgctgatgctccgagagcgcggccggttcagccccgcgcgatacttcgtcgaggaggtcatctccggcttcgacgagaccgacctctacaagacctgggtccgcacctcggctatgaggagtccccaggagcggaacacgcggctggagaacatgtcgtggaggatctggaacctcgccaggaagaagaagcagatagaaggagaggaagcctcacgattgtctaaacaacgcatggaatttgagaaagctcgtcaatatgctgctgatttgtctgaagacctatctgaaggagaaaagggagaaacaaataatgaaccatctattcatgatgagagcatgaggacgcggatgccaaggattggttcaactgatgctattgatacatgggcaaaccagcacaaagataaaaagttgtacatagtattgataagcattcatggtcttatacgcggggagaatatggagctgggacgtgattcagatacaggtggtcaggtgaaatatgttgtagaacttgctagggctttaggttcaacaccaggagtatacagagtggatctactaacaaggcagatttctgcacctgatgttgattggagttatggggaacctactgagatgctcagtccaataagttcagaaaactttgggcttgagctgggcgaaagcagtggtgcctatattgtccggataccattcggaccaagagacaaatatatccctaaagagcatctatggcctcacatccaggaatttgttgatggcgcacttgtccatatcatgcagatgtccaaggtccttggagaacaaattggtagtgggcaaccagtatggcctgttgttatacatggacactatgctgatgctggtgattctgctgctttactgtctggggcactcaatgtacccatggtattcactggtcattctcttggcagagataagttggaccagattttgaagcaagggcgtcaaaccagggatgaaataaatgcaacctataagataatgcgtcgaattgaggccgaggaactttgccttgatacatctgaaatcataattacaagtaccaggcaagaaatagaacagcaatggggattatatgatggttttgatctaactatggcccggaaactcagagcaagaataaggcgtggtgtgagctgctttggtcgttacatgccccgtatgattgcaatccctcctggcatggagtttagtcatatagcaccacatgatgttgacctcgacagtgaggaaggaaatggagatggctcaggttcaccagatccacctatttgggctgatataatgcgcttcttctcaaacccccggaagccaatgattcttgctcttgctcgtccggatccgaagaagaatatcactactctagtcaaagcatttggtgaacatcgtgaactgagaaatttagcaaatcttacactgatcatggggaatcgtgatgtcattgatgaaatgtcaagcacaaatgcagctgttttgacttcagcactcaagttaattgataaatatgatctatatggacaagtggcataccccaagcaccataagcaatctgaagttcctgatatttatcgtttagctgcgagaacaaaaggagtttttatcaattgtgcattggttgaaccatttggactcaccttgattgaggctgctgcatatggtctacccatggttgccacccgaaatggtgggcctgtggacatacatcgggttcttgataatggaattcttgttgacccccacaatcaaaatgaaatagctgaggcactttataagcttgtgtcagataagcacttgtggtcacaatgtcgccagaatggtctgaaaaacatccataaattttcatggcctgaacattgccagaactatttggcacgtgtagtcactctcaagcctagacatccccgctggcaaaagaatgatgttgcagctgaaatatctgaagcagattcacccgaggactctctgagggatattcatgacatatcacttaacttaaagctttccttggacagtgaaaaatcaggcagcaaagaagggaattcaaatgctttgagaaggcattttgaggatgcagcgcaaaagttgtcaggtgttaatgacatcaaaaaggatgtgccaggtgagaatggtaagtggtcgtcattgcgtaggaggaagcacatcattgtaattgctgtagactctgtgcaagatgcagactttgttcaggttattaaaaatatttttgaagcttcaagaaatgagagatcaagtggtgctgttggttttgtgttgtcaacggctagagcaatatcagagttacatactttgcttatatctggagggatagaagctagtgactttgatgccttcatatgcaacagtggcagtgatctttgttatccatcttcaagctctgaggacatgcttaaccctgctgagctcccattcatgattgatcttgattatcactcccaaattgaatatcgctggggaggagaaggtttaaggaagacattaattcgttgggcagctgagaaaaacaaagaaagtggacaaaaaatatttattgaggatgaagaatgctcatccacctactgcatttcatttaaagtgtccaatactgcagctgcacctcctgtgaaggagattaggaggacaatgagaatacaagcactgcgttgccatgttttgtacagccatgatggtagcaagttgaatgtaattcctgttttggcttctcgctcacaggctttaaggtatttgtatatccgatggggggtagagctgtcaaacatcaccgtgattgtcggtgagtgtggtgacacagattatgaaggactacttggaggcgtgcacaaaactatcatactcaaaggctcgttcaatactgctccaaaccaagttcatgctaacagaagctattcatcccaagatgttgtatcctttgacaaacaaggaattgcttcaattgagggatatggtccagacaatctaaagtcagctctacggcaatttggtatattgaaagactaaatctttgatctttgctggtcagcagaggaatcaaagcaggaatgtaggatcgaggagagtgacaggacttcccctctgtgcacttcgccgaaaagtaataatgggattgctatgcatggcccttgttgtacactagaaaattgggcacgcaaacttgtgtcagtttttccgctgttgcgaaattcagtgatggtgtttttgtaactataccaacctgtgtcagttttgccgttgttgcaaaactcagtgatggtgttttttgtaattattatacatccgaataataagactggtgtttccagacagactatgcaagctaaggggaaatcacgattttcct

SEQ ID NO: 7332 - DNA, 2606 bp, Zea mays
cacccattgctctcactcgctcccgccggttgctcgtccccggacccgccgcactactgctataggcgcatccccggcgccttcgcacactctctccccggccacttcccaaatccgcccgccattcatgcacccttctgtgcactgtcagcgccaccattagctcgcagctcaagctcgccactaccattttggtcggttcttgaggaaatcgatcgaaccgttggagtgccaccactggcagaggctgttgcattcttgagttgagcaggaagaggagaggaagcaatggctctgtcgacgttctctgtcccaaggggattcctcggtgtgccggctcaggactcccatttcgcttcggcggtcgagctccatgtcaacaagctgctccaggccaggcctatcaatctcaagcctcggcggaggccggcatgcgtgtcggcgtcgctgtcgtcggagcgcgaggcggagtactactcgcagaggccgcccacgccgctgctggacaccatcaactaccccgtccacatgaagaacctgtctgtgaaggagctgcggcagctggccgacgagctccggtccgacgtcatcttccacgtctccaagaccggcggccacctcgggtccagcctcggcgtggtggagctcaccgtcgcgctgcactacgtcttcaacgcgccgcaggaccgcatcctctgggacgtcggccaccagtcgtacccgcacaagatcctgacggggcggcgcgacaagatgccgacgatgcggcagaccaacggcctggcgggcttcaccaagcgcgccgagagcgagtacgacagcttcggcacgggccacagctccaccaccatctccgcggcgctcgggatggcggtgggccgggacctcaagggcggcaagaacaacgtggtcgcggtgatcggcgacggcgccatgacggccgggcaggcgtacgaggccatgaacaacgccgggtacctggactccgacatgatcgtcatcctcaacgacaacaagcaggtgtccttgcccacggcgacgctcgacgggccggtgccgcccgtgggcgcgctcagcagcgccctcagcaagctgcagtcaagcaggccgctcagggagctcagggaggtggccaagggagtgacgaagcagatcggtggctcagtgcacgagctggcggcgaaggtggacgagtacgcccgcggcatgatcagcgggcccggctcctcgctcttcgaggagctcggtctctactacatcggccccgtcgacggccacaacatcgacgacctcatcaccatcctcaacgacgtcaagagcaccaagaccaccggccccgtcctcatccacgtcgtcaccgagaagggccgcggctacccctacgccgagcgagccgccgacaagtaccacggtgtcgccaagtttgatccggcgaccgggaagcagttcaagtcccccgccaagacgctgtcctacaccaactacttcgccgaggcgctcatcgccgaggcggagcaggacagcaagatcgtggccatccacgcggccatgggcggcggcacggggctcaactacttcctccgccgcttcccgagccggtgcttcgacgtcgggatcgcggagcagcacgccgtcacgttcgcggccggcctggcctgcgagggcctcaagcccttctgcgccatctactcgtctttcctgcagcgcggctacgaccaggtcgtgcacgacgtcgatctgcagaagctaccggtgcggttcgccatggacagggccgggctggtcggcgcggacgggccgacccactgcggtgcgttcgacgtcgcgtacatggcctgcctgcccaacatggtcgtcatggccccgtccgacgaggccgagctctgccacatggtcgccaccgccgcggccatcgacgaccgcccgtcctgcttccgctacccgagaggcaacggcgttggcgtcccgttgccgcccaactacaaaggcactcccctcgaggtcggcaaaggcaggatcctgcttgagggcgaccgggtggcgctgctggggtacgggtcggcagtgcagtactgcctgactgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggcgggttcggctcgcacgtcgcccagttcatggccctggacggccttctcgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgccaaacgcgtagaacttgtgctgatctgggcctatagagatgattgtacattttgtcgttaactagagtgtctgaacttgggagattagtcttctttggatgaaagtgtcgccggaacaacagttaccgtttctttttttgaaagagaaaggcaaaagatttgccattcc

SEQ ID NO: 7333 - DNA, 1681 bp, Zea mays
gcaaaagcgcaaacgcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacaggaaatcttgctggtct

SEQ ID NO: 7334 - DNA, 1927 bp, Zea mays
ccacgcgtccgcgcgtgcccgcgagcgtgccacgcaagggcgagggagcccgcgaggcggaatgcccctcgagatctcctctgcgcggctcgcgggccagaccatcagaagcagcaagtcgcattagtaaattcaatcatcgtccccgcctgcaaaagatctgccgtggcctcctcgtttacctattgctggttctcaaatcgcacgccctcactgctagtgctaggctccccttcgcgcgcgcgcgcagttattaccccgtccacggccgcgtgttcgcaagcatccagatccggcttcccacctccggcgaccaccgcgcagagaacaattccgtccaacgggaaaccccgcgataaatcgccgcgcccatcgtttggcgtccccccacaccaccgaattcaccagggctggaggaagcgtctgaaagatgtctaatctctcacacacctcaaaggaagatacttcacctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcaatcatgaaatttccatatcctggagccctgacagctctgcagtatttcactagtgttgctggagttctcctatgcggacagctcaagctcattgagcatgacggccttaatttgaggacaatgtggaagttcttacctgctgctgtgatgttctatatctccatcttcacaaacagtgaactcctgcttcatgccaacgtggatactttcattgtgttccgctctgctgtgcctatatttgtcgcgataggagagacgctgtatctccatcagccatggccatcactcaagacatggctttcactctccacaatacttggtggaagtgtgatctatgttttcacagacaaccaattcactgtgactgcttacacctgggcagtggcctacctagcaagcatgtccattgatttcgtgtacatcaagcatgttgtaatgaccattgggctgaacacatggggccttgtgctatacaacaaccttgaggccttgatgctattcccactcgagcttctcgtaatgggagaatttgatcagatgaaggtcgacagctccaaagtgtcaaactggctttcatttgatgtggtcctccctgttgctctctcatgcctgtttggactatcaatatccttcttcggattctcctgcagacgagctatttctgctactgggttcacagtgcttggcatagtgaacaagctcctaactgttgtgattaatttgcttatctgggacaagcatgcctcttttgtgggtaccattgggctcttgatatgcatgtcaggtggtgtgctctaccagcaatccaccacgaaaccgaaggcacccaaggttgagccgaaggaagagagcgacgaggagcagcagaaattgctgcagatgcagggagttcaagagagttcataaaccttacaaagaaagtacaattacaaagaagcatatggctagtacttggaaagaggacagcctcacctgaacgtttttgtattggctagtacttgggaagaagcatatggatgaatgtagtcatgaactaggagctacaaaatcccatgttttagatattagaagtcatggaggggacctaattatcactgtgcaattctttattactatactaccacttccatttgtaacgcaaaattgttatgataggatggcaaatatacctgcatcgaatacttcctatacgaaagcacctatctcatacagttaggtgacggtgatactatgatctatgtttagtcatttcaaaaaaaaaaaaaaaaaaaaaaaaaaaaaaaaaaaaaaaaaaaaaaaaaaaaaaaaaaaaaaagg

SEQ ID NO: 7335 - DNA, 769 bp, Zea mays
ttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaatgttcccccatgttctgtttctcgttctgattctgcaattcgtcatattgttgaatttaatggttatgtggaatcgct

SEQ ID NO: 7336 - DNA, 825 bp, Zea mays
gttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7337 - DNA, 1437 bp, Zea mays
cgggaggagaccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatcggcagtcaccgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctgaatggacggtcattgttgaactaccctttttcaggaggggcaactttcttcatactgctttcctgctccctggccgtgttctgcaacatgagccaatacctctgcatcgggcggttctcagcgacctcgttccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttttgtaactgtgcgcgcgcggtcgctcgatgcaaagttgcttgttcgtcggttctcagctatcgacactacactgttaattttgttggccccttgttggggggagtctgctcgtaggtgaccccccccccccctcccccgggttcgacgtagatgaaacacacgcgggcagattgttaggatttttcaggcggggaggtggcgacatgctgttatagatggtgacaagactttatataatggaaatgcaggtgtttttgaggtttc

SEQ ID NO: 7338 - DNA, 1845 bp, Zea mays
cctccctcactctcgttccatttccccatctcccagatccaattcgcgagttctccctcctctgcggccatggcgctctctgtggagaagacctcgtctggacgggagtacaaggtcaaggatctctcgcaggcggacttcggccgctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 7339 - DNA, 1678 bp, Zea mays
ctcctctgcctttccccatcgtctctccgtctacacctcatcataatcacagagcgctagggaggagagagggggaagagagagggctagggtttcgtgctccctcacgcaacgaatccgagccggatcggggggtgcgcggagtcaccggcggcccggcgttgcctgggctgtgatacagttgcaatggcatctgtaactgatgagacagctaagattgagggtttgacatctgctgcagcctttgtggagggtggcattcaggacgcatgtgatgatgcatgcagcatttgccttgaggctttctgtgagagtgacccttctgcattgactggctgcaaacatgagttccatctccaatgcattcttgaatggtgccagagaagttcacagtgcccaatgtgttggcagcctattactatgaaggatcctaccagtcaggagctgcttgaggcagtagagcgtgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggaggggcacaggggacgatctggctctcatggtcgtccacatttcctagttttctctacacaaccaaattcaccttctgctggcacaatctcttcatcttctgctcatatggagggagaaaatgattcaaatcctgccacacctagagctagcgagtcatctccacgagctattcgcattggagaagtgggaaaccaaagtcctgggatgcttacctacgatgctgaacaggatgctgtcgtttcttccggaaatagcactcctgtatcgagtcctaggttttttaacaggagacactccactggacagtcaactccagacagggctgggccatcggatattcagtctttctcagactccctgaagtcccgcttaaatgccgtctctatgaagtacaaagaatctattacaaagagtactcgagggtggaaggagagattgttttcacgtaattcatccgtggcggatcttggttctgaagtgagaagagaagttaatgctggaattgcgtccgtatcacggatgatggagcgtctggaaactagaggaaatagcagaacaagtgatagcccggcagcatccacttctgaagttccccctgctacagaatcaagcaatgaaagggttacagagagcaactctgctgctgctgctggtggtggtggtactaccactacgggtaccagcgctagcaacgcctccgccccttgtgttgcgacatccggttcaaattaggacatgtttgtgagcctggcggcagagcagaagtgcagtaacatgatgccgtcatttttttctcaaccactgcataaacggctgcaaggggaaaaaaccaaacggtgatttgatgtattggctcgataaaatggtggtgcgtgtggcctaggagaagtcggatttcatcttctgttttcgtctctttgtaaaaaaaatcgtctgagggcagatgtttaccggtataaataacggatatgtcatcttcatagtacgtggatcagttataaatatgattggaacagcaaagcttgctgctgtt

SEQ ID NO: 7340 - DNA, 940 bp, Zea mays
ggtctcccatccctgaaaacctcacaaaaccctcgctcgctccccaccaccccgccgcgccgccgcctgtaccagctgcgtcaagatgagtggcattgtcttctgtagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggtggtatgggcggcatgggtggcatgggtgatatggctggtatgggtggtcttggtggcatgggtggtatgggtggtcttggtggcatgggcggtatgggaatggatgatttcgaagatgagagtgatgatgaagaagaagtgtcgaaacctcaagctgcggacaaggctgttgaggctgaggagacggagtcagcggaaaccaagattgaggcggctcagagcagttgaagatgcttatgatctaagctagattgtatcctcatgttaattctgctgaatcggaggacaaaccttacatttatggtgctggcaagtcccagtggcgtgccatgaaaatttacgttccgtcttttaactgggtatccgagtgtcgtgctcagcatattatggatattatttccgtaatgcttcctttggtcgccaatcatgtggtgaagagtttgtttt

SEQ ID NO: 7341 - DNA, 998 bp, Zea mays
agctcctccgagtcaacagtcttggctaccttctccatgaactcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 7342 - DNA, 1672 bp, Zea mays
ggcgaggcaaaagcgcaaacgcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacagg

SEQ ID NO: 7343 - DNA, 749 bp, Zea mays
tgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttcttatttgcaacaacaacaactaccattcagccagctatctgctgcctacccccagcaatttcttccattcaaccaactgacagctttgaactctcctgcttatttacagcagcaacaactactaccattcagccagctagctggtgtgagccctgctaccttcttgacacaaccacaattgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctgatgtttgtggcttcccagaaataagaaagtacatttctagattctt

SEQ ID NO: 7344 - DNA, 1316 bp, Zea mays
accttcaaccgctacatttccgtcactaccggagccgccactcccacgaacgcgggcggcggaacggaagcgaaccagttatctagtggagttgcctccttcaagctactctaatgtcctttctattcaagtctagcaatggcggcaccactgaaaaaatcccatccccagaagaacagcgagaaaaaataaatgaattacgcaaggagcttggtgaacactcatcagcagccattaaagacttcctttcagatgcctcgttagcgagatttcttcgagcaaggaactggaatgtgcagaaagctagtaaaatgatgaaagcagctgtgaagtggcggcttgcattcaaacctgaaaacatctgttgggatgatattgcagaggaagcagagactggaaagatatatagagcggattataaggacaaacatggcagaactgttcttgtattgaggcctggcttagagaacactacctcagcaataggacagatcaaatatctagtctactctctggagaaagcaattatgaacctgacggaagatcaagagaagatggtatggctgacagatttccagtgctggacattgggaagcacaccactgaaggtgacccgtgagactgtcaatgtcttgcaagactgctatcctgagaggttggggcttgcaatcctttacaaccctcctaggatatttgaatcattctggaagatagtgaagccgttcctagaccatgagacccgcaagaaggtgaagtttgtgtactccaacgacaaggagagccagaagataatggcagaagtctttgacatggaggagctcgactcggcattcgggggaaagaacccagcgacatttgagtacaacagctacgcagagcagatgcaggacgacgacaagaagatgggatcttcgcacggctcagccaatagcttgcttggatcagctgggaaggaggctaatggcgcagactcggacgcctcaagcgaggcctccttctacagtggaactgactctccgacacatgagaacggtgaacacagcatcgcgaagaagaatggttgagctgagttgaactgctttgattgctcaaactgagggagctgactaatgtagttggtcaacataacagttatatctagcttgaacgattgtcaggaccgatggcgatgacagattccaggctggttagatcaccttgtcgggtctaggcggaatgtatatttgctgctcatgatattatagtatgtaagaccataaacggtgagtttgtgatgcgctatatatcttggaataaagttcaacttcttcgttttc

SEQ ID NO: 7345 - DNA, 1675 bp, Zea mays
ctgaggagcttgatagagagatgggacttataaggacgcaggaggagactggtagacatgttaggatgcttacacatgaaatcagaagtactcttgatagacatacaattttgaagactactctcgttgagctaggaaggaccttgggtctggaagaatgtgcattgtggatgccatctcgaagtggctcaagccttcagctttctcatactttgcgccaccagattactgttggatcatcggtgccaatgaatcttcctgtcgtcaatcaagtgttcagtagcaaccgggcaatcataataccccacacatcttctttggcgcgggttcgacctcttgcagggcgatatgttccaccagaagtggccgcagtccgtgtacctcttctacatctttcaaactttcaaataaatgattggcctgagctctcagcaaaaagctttgcaatcatggttttgatgcttccatctgatagtgctagaaaatggcatgtgcatgaattggagctggttgaggtcgttgctgatcaggtagcagttgcactatctcatgcagctattcttgaagagtccatgcgggcacgtgatttactaatggagcagaatgttgccctggatttagctcgaagagaggctgagatggctatccgtgctcgcaatgatttcctagctgttatgaatcacgaaatgagaacacccatgaatgcaataatagccctttcctccttgcttttggaaactgagcttactcctgagcagcgtctaatggtggaaacggtactgaaaagcagcaatttgttagcaacactcatcaatgatgttctggatctttccaaactcgaggatggaagccttgaactggagattaaagcattcaatcttcatgctgttttcaaagaagtgatgggtttcattaaaccaattgcatctatcaagaggctatctgtatcggttatgttggcaccagatctgccgttatgtgcaattggtgatgaaaagagactcatgcaaactattctgaacatctctggcaatgctgtaaagtttaccaaggagggacacatcacacttgtagcttccattgtgaaggctgactctttgagagagttcagaaccccagaatttcatccaactgcaagtgatgaacatttctatttgaaagttcaggtaaaagatacaggctgtggagttagtcctcaggatctaccccatgtattcacaaagtttgctcatcctcaaagtggaggaaaccgagggtttaatggtagtggtcttggccttgccatatgcaagaggtttgtcagtcttatgggagggcacatctggatcgacagcgaaggaaccggaagaggttgcaccgcaacattcgtcatcaagctcagcgtgtgtgacaacacaaacacctaccagcagcagctggttcctctagtctggccaagcagtgcagactccaatttgtctgctccgaaagtgctgcccgacgggagaggatctgtttccctgaaatctcggtaccaaagaagcgtatgagctcagtgtaaatgattgacggcatagtgccaagtaggggatcgattagtgccattgtctaattttgtttgtaacccagtcatagcaacatatagtgtacaaataatgtaaagccaatggagactgcagctgtgcatctgggtagc

SEQ ID NO: 7346 - DNA, 648 bp, Zea mays
cacgtccaggctagtgctgggggtcaccacgacgctggtgatcgtcaactgcctcaccacgttccagatctacgccatgccggtgtacgacaacatggaggccgggtacgtgcacaagaagaaccgcccgtgcccgtggtggatgcgctcgggcttccgcgccttcttcggcgcggtcaacttcctcatcgccgtcgcgctgccgttcctgtcgcagctcgccggcctcctcggagggatctcgctgccggtcaccctggcctacccgtgcttcatgtgggtggccatcaagaagccgcggaagggcaccgccacgtggaacgtcaactgggcgctgggaatcctcggcatgagcataagccttgtcctcatagtcggaaacctgtggggccttgtggagaaaggcttgcgggtcaagttctttaagcctgccgattcccagtgaaaaaaaggatgcagatttgtcaatcggttagatttgtaatgccatgcttttatatatgttgatttcttcgccaagaacgtataatgtcctcctgcaccttgacaatttgcaagaaagcaaagtccagttaaggtactcgtggtcgttcctcgtgccattgtgccttttgctcatttttttttctttatttatgcgctttatat

SEQ ID NO: 7347 - DNA, 1693 bp, Zea mays
ctggcgaggcaaaagcgcaaacgcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacaggaaatcttgctggtcttgcc

SEQ ID NO: 7348 - DNA, 1261 bp, Zea mays
gatcgggcgtaccccggtgcccgttcaccgccgttcacgccgcgtgtgcgctctggctctgccgctctctctctctctcctgcgcgtggcgcagctgccgtcctataccaggcgcccaggtctagcctcgtcggtgccttcgccaggtctttctcgggcccttcgccaacgacgagcgcccgctaggttagaaggtatgcattcgtgttcataatattgtatttgactaaaaagactgggcctacgcatgggggctccaaaacagaggtggacttctgaggaagaggctgctcttagagctggagtagccagacatggagttggaaattggcgcatgatattgaatgatccagaacttagctccacattgcgctaccgctcgaatgttgacctaaaggacaaatggcgcaacatgaatgtaattgtcacttcatcgagtactcgtgacagggggagaacttccacgaggagaacccgagctgctcctaagaataatgaccaattgttggcaatgagcacaatcacttctgaggttgatgatgagattgttgatgtaaagcccatagtatcaatgtctgttgaaggatggaatacttcaaattcaaagaaatctcactcaaggctagacaatattataatggaggctataaagaacttgaatgagcctacagggtcccacagaactactattgctaattacatagaggagcaatattggccacctagtgattttgatcacttattgtctgcaaaactgaagtatttagctaccagtgggaaattgttgaaggtgaatcggaagtacaggatagcacctagtttgctggaagacgtgcaaagagaacccttgaaattagggagtgatgctagtagaacccttacaagatcccaagtcgatgctgaattggtccgtatggcaactatgactgttgaggcggcggcggcagctgctgctcatgcagttgcagaggcagaggctatcatggcagaagctgaagcagctgctagggaagcagaagctgcggaagcagaggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccgaagattatgatttcc

SEQ ID NO: 7349 - DNA, 1972 bp, Zea mays
gaagaggggaggcgcgacaaaaagggcgccgcgcccccgcatcgcccccgacgccggcatctctccctcgctctccttctcccgatctgatccgaagcgcggcgtcgacgacgacgacctaagggcacgatgcattcgaccaacctgctgctggaggagcccatccggatggcctccatcctggagccatccaagaccagtttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaagaagcctcctccaccttgctgcccatcaacttcgatggactcgccaaggctttgacaccaggtgcaacgatatttgtgggccaatacttgttcactggtagcgagactacttcagtttggttggaggtttctgaagttaaaggagatgatgtggtttgtatcatcaagaacacagctaccttggctgggtcgctcttcacgctgcattgttcccagattcatattgacttgcccacgctgtctgatgaggataaggatgttatcaaaaaatggggtgctccaaataagattgacttcctctctctgtcttacacaagacatgcagaagatgtgcggcaggcacgtgagttcctctcgaaattgggtgatcttagccaaactcagatctttgccaaaattgagaatgttgagggcttgaaccattttgatgaaatactggcagaggcagatggtatcattctgtcaagaggaaaccttggaattgaccttccacctgagaaggtctttttgtttcaaaagtctgcgcttcacaagtgcaacatggctggaaagcctgctgttgttactcgtgtcgtggacagcatgactgacaacctcagacctactcgcgcagaggcaactgatgtggcaaatgcagttcttgatgggagtgacgccattctccttggtgctgagactctccgtggtttatatccggtggagactatttcaacagtgggcagaatttgtgctgaggcagagaaggtatttaaccaagatttatactacaagcggactgtgaagtatgtgggagaacctatgacccacttggagtctattgcttcttcagcagtgcgagctgcaatcaaagttaaggcatcagtcatcatttgcttcacctcttctggacgagctgcaaggctcattgctaagtacaggcccagcatgcctgttctatctgttgtcattcctcgtctaaagacaaaccaactgaagtggagtttcacaggtgcttttgaggcaagacaatcactcatagttagaggcctcttccctatgcttgctgatccgcgacacccagctgaatctaccagtgctacaaatgagtctgtgttgaaggttgctcttgaccatggcaaagcctcgggcgtgatcaagtcccacgaccgcgtcgtcgtttgccagaaagtgggtgattcctctgtggtgaagatcattgagctggatgattagacaatcaggctatgctattgtctactagggcacgttttgccaattttttgcctaggccgaaacttattggctatgtataatcctatagcgcttgaaaactgagcagtttttcctatggtgccatcataggatttgcttttacagttccaattatggtgtagttcaaaaattgctcgactaaactgcggtgtaacagttaaatgggcagatggaataatgtaatcatactgttcctcgttaggttgtcacttgaattgat

SEQ ID NO: 7350 - DNA, 1470 bp, Zea mays
gggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggatgtttccccgggggcggcatgcctgggggtttccctgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaaccaaacggctctatggtgatgtatgcaaaaagttgctttcgaacttgatttctcaattcacagatggtttgacagtttcttg

SEQ ID NO: 7351 - DNA, 1238 bp, Zea mays
caatctcgcagtcctttcttcctccgacctcctcagaccgcagcaaatcggacggtcggaccaggggatagggttccgccgcgcctctccaaccaggcgccactcgccagggcctaggctggtcatggaaggaaacgccgcagccgggaagaggtcccggacggagacggcgaacggggctgccggcggcgggaagcgctccaaagacatggagtcatttcaaactggtctatcaagcaaatcgaagccttgcaacaagtttttcagtacgattgggtgcccgtttggtgagggatgtcgttttctgcactttgtccctggcggttacccggcagttgcaaaaatgctcaatctaggtagccctgctgtatctgcgccatcaagaactcatgtggatcacgccgctcttactggcgcctctcattcagcttcgtcaggcaagacacgcatgtgcaccaagtacaatactacagaaggctgcagatttggtgataagtgccactttgctcatagcgaaagagaacttgggaaaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggcataattggtaagggcggggtcaacactaagcagataagcagagttacaggcgtcaagctctgtatccgcgaccacgagtctagccccaacctgaagaacattgagctggaaggcaattttgaccagatcaagcaagccggcgaaatggtgagggacctcatcgcgaccatcagcacgagcatgctggcgaaaaactcatctgctgccgtggctccatctggaggccgaggcggtggtctgggtggcaagagcaactacaagacgaagctatgcgagaacttcgtgaagggtgcttgtactttcggcgagcggtgccactttgcccatggcgagaacgagcagcggagaggtgctgtttgagagttgaggtgccaactccaggcatgacatgtcctgtgctctccatttgcttctctgaatttcctccttgtagcgttagacggttagactgtcgtattgctatttcaatggtttcaactgagttcagctttaagaaaacgttaatctgttgtgcccctgaatgttgtgacttgtcagtaagttagcagctgct

SEQ ID NO: 7352 - DNA, 1013 bp, Zea mays
ccacgcgtccgaaacggacgaccgagaccgcctgggcggatccgagttcggacggcccatcagagcatcagacgaccaccttcctgcccccattcgttttcgcatcggcgtatctcccggcggccggcaaaggcgctctcgacctccctgcggtgccggtacgacagtcgacaggatggcaatggccacatcagcatcgtaccctccacctcctccattttaccgattgtacaaaaattttgagcaagatccctcatctgcaccagaacctccaccaccaattgacgaaccattcaaagccttgggtgttgattacacaggagatgttgtgattccaagcttggagagtcataatgtccgtcagctttatccaaagggtcccaatattgacttcaagaaggagcttaggaccctcaacagagagcttcaattgcatattttggagctggcagatatattagttgagagaccatctcaatatgctcgtagggtagaagatattacgctcatattcaagaacttacatcatcttctcaattccttacgacctcatcaggcaagggccacattgattcacatgcttgagagccaaattcggcaccgcaaggaagcaattgaagatataaagcagaggagggaggaagcgcaaaaggtgcttggggaatcactgcttatcttggatggaagtcaaactaactaggctgacgccgtcaaggtagttggttcaagaccgattcttctatgagttagtgtgttagtagaatagaagacaagatgtgtctggattgttgtggtatcatctgttgtggcttgtggtatttccagctttgataactgaattttcttacttctatggtctatgttagcaaagttggattactttcttacttccattggtactcaactgcatcatgggttactttcttgtggaagtgtatattgtgagattgatgcctcgtggccagcttaattgaaaggttgttatatgctaaaaaaaaaaaaaaaaaaaaaag

SEQ ID NO: 7353 - DNA, 780 bp, Zea mays
ctccactcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaatgttcccccatgttctgtttctcgttctgattctgcaattcgtcatattgttgaatttaatggttatgtggaatcgct

SEQ ID NO: 7354 - DNA, 1193 bp, Zea mays
cgtcctcctccggtcacgcacgcagctagcttacccgccccgccactataaaaatccacctccaccccaccgcgcgtctacagttccacacacgcgtgcacgggcgggcaagcaccagaaaggaaaggcggaggccgcgcggcgggcgccagctgcagccaagagcccactagtagtagtagtagctagttcaccaccgcctgcttgcctcctttactttgccatatttgctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacaccc

SEQ ID NO: 7355 - DNA, 1637 bp, Zea mays
agcatccgcttccttgctcgccttttctttaaggcctccaacggtggagccggaataaactccggccacttcggcatccgccgggaatttgattcttctcccctaaatactcacgctaccttccacctccccctacttctctccctcatcttcttcgctaccagccagacaggcagctcacgtgtgcaggcagcggccaagatgatggcggaggcgtggacgccggtgccgttcccgccgacggcgccctgcttctggctgcacgacgcgcactcggttttctggcggggaggagacgcgtggacggcggcggagaacaaactgttcgagaaggcgctggcgcagatcgaccgtaacgcgcccgacaggtgggagaaggtggcggaggtggtgcgcacgaagacggtcgacgacgtgaggaaccactaccacgacctggagaacgacgtcggcttcatcgaggccgggctcgtgccgttcccgcactacagcggctcggttccgtcgttcgggttcacccacgaggattgggacggagggttcaggcgcggctactgccttaagcgcgcgcgcggctccgacccggagcggaagaagggcgtcccctggacggaggaggagcacaagcttttcttgatgggactgaagaagtacgggagaggggactggaggaacatctcgcgcaagtacgtgacgacccggacgccgacgcaggtggccagccacgcgcagaagtacttcatccgcctcaactccggcggcaaggacaagcgccggtccagcatccacgacatcaccaccgtcaacctccccgacgaagaccgcggcaacgcgccgccgtccgcggtcaccaccaccaccaacccctccgtcgccctcgtggacatgaagcccttcgttgcgccgtcgctcggcgtgccgcacccctacggcgacgtgaagctggagcctaagagctcgctggtggccggcctgggcttcaacgactccgtcctcctgatgcactgcggacagttgtgacgggctgttcttgcggcgagaaccgctcccgtcgcaacgtgcgccaccaaccaccgcctcatctatccccgggcgggcatcagggccggcggcacaagtcgcacgtcgtcgtgctaggcttggatgcagagttgcttcaggtgtactcctaccgatcagatggctggcacgtcccgccgcgtgtgacgaggatgaagagtggaacagtctcgtcgtccagctgccagctcgcggcagctccgagtggctgtgttgtgttcatcgagaacaagaggccatggcccatgggcgtacgcgtgccgttccagcgtccatttcggttcagtgtacaaaattcgacaagtacagagtccaacaacttccacggtaccgaacaataaagcattcgataaaaagcctcttccagcgtcaccggcggcttggattaggatccaggatcagaagatttctgtaccggcttaattgttaatgtatttttggtgtgtgcaacatctcccaccagatggtgttaacacttgtagtgtgtgatgcttgtagtggggtctcgcaaggtttttgtccgccattgttgctttgccagttactagctagtagaagtttagacatgatgttctatt

SEQ ID NO: 7356 - DNA, 1175 bp, Zea mays
cgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcctaaatctatggctcgtctcagtggtctagt

SEQ ID NO: 7357 - DNA, 1551 bp, Zea mays
gacgaggccagccacgcgcaaaccgaatccaccaacgtcaaacgaccgcaccaaccaatccacttcgccggcgatccgtctcatctcgtcgcgtctccggcgccggcagacacgggtaacgcggctccgagatcggcgggcaggatgatgatgctgatcgattgctcggggtgccgtaccccgttgcagctgccgcacggggcgccctgcatccgatgcgccatctgtggggccgtcacgcacatcgcccccgcccctcccgccgagcccaaccgcggcgccgtacaaccggcgccggggtgggcgccgccgccgccgccggtgcacggacggaagcgcgccgtggtgtgcgggatttcgtatcggtactcgcggcatgagctgaagggctgcatcaacgacgccaagtgcatgcgccacctgctcatgacgcgcttcaacttccccgacgactccatcatcatgctcaacgaagaacaaacggacccctacaaaatcccaacaaagcataacataaggatggctatgtattggcttgtgcaaggttgtcaacctggagattcattggtgttccattattctgggcatggatcacaacaaagaaattacagtggagatgaggttgatgggttcgatgaaaccctctgcccgttggattttgagacacaagggatgattttggatgatgagataaatacagcattagttcgaccacttcctcatggagttaaacttcatgcactcattgatgcttgtcatagtgggactgcacttgatttgccttatctctgcagaatgaacaggagtgggcaatatgtatgggaagatcaccgaccgcgatctggtgtctggaaaggcactagtggtggggaagctatttcctttagtggttgtgatgatgatcagacctctgcagatacctctgctttatcaaagatcacttcgactggtgcaatgacattctgcttcatccaagctattgaacgtggacagggcaccacctacggtagtatcctgaactctatgcgttccacaatacgcaacacaggtgactcagcgggtgtaggtggcggtgctgttacatcactaattacaatgcttcttactggagggagcctttctgctggtggtctgagacaggagccacaactgacggcgtgcgagccatttgatgtctatgcgaagcccttctccctatgacgtgttcatagtattgcccaatgtactatggggttgtttgtttcggcttctggcagcttctggccaccaaaagctgctgcggactgccaaactctcagcttttcagccagcttctataaaattcgttagggcaaaaaccatccaaaatcaacataaacacataatctgttgagtcgttgtaatagtaggaatctgtcactttctagatcgtaagccctatgaacaactttatcttcctccacatgtaatcataataatactcagattctccccacagccagattctcagaaaagctggttagaaaaaagctgaaccaaacagcccctatatatctcctcccatttcacgtt

SEQ ID NO: 7358 - DNA, 706 bp, Zea mays
ctcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaatgttccccc

SEQ ID NO: 7359 - DNA, 1221 bp, Zea mays
gttactcacttgggaatcaatgcacatttccctttttaatcatagtgccttgttgacaccttttgtctctgtgcaagcaggaaggatttggaggatgacagaagctgcagttacaaggtactggtgccatggatgtgtgagggttgttgaggaggccatgggggaggagatcaagtgcccattttgtggtggtggattcattgaagagatgattggtgaggaatttgatgggttggccagccagcagtcagagcgggattcatcacaatggggagcgtcgaacaacccctttgagcagccaagggcggaggcggacagtgaggatgaagaagatgatgatgattacgatgatgatataggccgtgcatttgagagtttcatcaggaggcatgggcggccatcagctctccgtcgggcgtttgacagcatccaggacgaccttagagctgatagggatagtgacttctccattctgatcaatgccttcaaccaagccctcgctttgcaacgctcagtgcttgatgctgatgaggcccgagatgaccaaggtggatctagcaatgatgatggcttgatggaagaatatgtcctgggggctgggctaaccctgctgcttcaatatttgactgagaatgatccaagccagtatggcacccctcctgcaaacaaagaggcggttgacgctctgcccactgtccaaatagcagaggctgtcagctgttcagtctgccttgatgatcttgagctagggtcccaggcaaagcaaatgccttgtgagcataagttccactctccttgtatactgccatggcttgaactccatagctcctgccctgtgtgccggtttgagctgccatctgaagagacagaagatttggatgagcctagcaatgtggacagaacagagaacacccatgaggaagtcagggccgatggccctgaagatgacagtgagagcagtaacagagcgtgggcccttgttccttggttcagtgggctattctcaacacctgaaccacaaactgtcagaggcgctttcactgatcagcagactcgctccacttctggaaccaacatgaatgctggcgaaagctgatctcttcctcctttgtgaataatgcccatacatctgagaatagcaatggaccttgtcagtagataacttatttttctgtactgataatccttcttggatgaatcgcaaggtacaaagtttgtgac

SEQ ID NO: 7360 - DNA, 673 bp, Zea mays
cttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtc

SEQ ID NO: 7361 - DNA, 1997 bp, Zea mays
cccactccactcgaattaaaaccctagcggcaaaaccttcgctctgcgccgccgtcgcctgctcccgtcccgccaccacatccgcccaggagctcgccgtcggggaggctgctcgaggagccgcgctgtctctcccgcgccgcgaccttcgccctcgccgccgccatgatctgcgcgatctccggtgaggtgccggacgagccggtggtgtcgaagaagtcggggcttctcttcgagcggcggctcatcgagcgctacattgaggaccatggcaagtgccccatcaccaaggatgagcttactatggatgatatcgtgccggtcaataccaacaaggtcgtgaagcccaggcctttgcaggctgcaagcattccaggactccttgggatttttcagaacgagtgggatgctctcatgctttctaattttgctttggagcagcagctacacacagcaagacaagaacttagtcatgcactctaccagcatgacgctgcctgccgtgttatagccaggttgaagaaggaaagagatgaggctagagcacttttggctcaagctgagagacagattccagcatcagttgcaggagctgctcctgcagctgttgtttccaatggaaaaagagcaatggaagatgaaattggccctgacggaaagaagattcgtcctggtatcaaccctgtcatgattgatgaacttacagagtgtaataccatgctttcagcacagcgtaagaaaagacaggttcctccaactctggcaccattagatgcactcgagagatacactcaaatctccagccatccccttcataagacaaacaaaccaggcattttgtccatggatgttcatccttcaaaggatgttgttgcaactgggggtatcgatacaaatgcagtaatctttgatcggtcatctggtcaaatcttgtgcacgcttactggtcactcaaagaagataaccactttaaagtttgttccacgggatcaactctttgtaactggatcagcagataagactgttcgcatttggcaagagaacgagaatggaaactataactgcgtccatacattgaaagatcatactgctgaggttgaagctgttacagtacatgcgactcagaagtattttgtgagtgcttccaaggataattcgtggtgcttctatgatatttcaacaggatcttgcctgacacaggttggcgaggcttcaggacaagagggatatacatccgcgtctttccatccagatggtcttatccttggaacaggaactactgatgctgttgttaaaatttgggatgtgaagactcagtcgaatgtcgcgaagtttgaggggcatgtaggaccagtcactgctatgtccttctctgaaaatggttacttcctagcgactgctgctcatgatggtgtcaagctttgggatcttcggaaattaagaaattttaggaccttctctccctatgattcagatacgccaacaaatactgtggaatttgattttagtggaaactatcttgccattggtggttcagatataagggtctaccaagtagctaatgttaaggccgaatggaatctcatcaagacattaccagatttatctggaacagggaaagtaacttcggtaaagttcggagcagatgctaagtacatagccgtaggttctatggaccgcaatctacggatatttggcctccctggagacgaccaaatggaggaatcaaccacagcggcagagtgaggaaaatccatggtacctaatttcctcctcctggtatactccgcaatatgttctgatgatgggtagactgagtgcaaatggatacatcacgagagaagggtcctcgcggcgatgaactggcttgagcttcggtcggtgtaaacaagctgtgacattattgtattgtaggcctcactaattcgtctgatggggatacaatttgttttgatgagtacgagtgtacgacgctaaacagccaaagttctatgcat

SEQ ID NO: 7362 - DNA, 1130 bp, Zea mays
ggtgaagccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggttcttgcttctgcttactcgcatgagttgccacgatatggtctcgaagttggtctgaccaactatgtagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacgtacgagcagaggaaggccagtctcattgaaaggctcaaccaactcaactcctcgggcggcgcagatgacgacgatgaggatgacgagtaaagtttggcccatcgaagtagtgctatcttatgcggcgatcagtatttgtgctatggcatttatcgctacctggagtcgtgcaacatgcatttttgtttaagtttgtcgatgcgaacaaagttgtttctgttagtttggagctggagttctgaatatttacttttataatatt

SEQ ID NO: 7363 - DNA, 824 bp, Zea mays
ttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7364 - DNA, 1700 bp, Zea mays
gctcccggccccccgctgcataaatacctcctctcgcggcccattcccacctccccctcctcgccgctccgggctgaccaagggctcgccgcctcccgtgtcctccgactccgacagggaaaggcgaaaccttgggtcggctcgctagtggagtgcagggtacgttgatgacggagctgtggatggaggtgctgccgccgccctacttcgcggggcaggcggcgggcgggtggttcctgccggaccggcgggccgggcccggggcgtggacgctggaggagaacaagatgttcgagcgcgcgctggcgagggtcgactgggacgcgccggaccggtgggagcgggtggccgcgatgctgcccgggaggacggcgtccgacgtcgcggcccactacgacgacctggagtgcgatgtcggctgcatcgaggcgggcttcgtgcccttcccctgctacggtagcggcggcggcggcggcgcgtcgcaatccgccgggttcacgttcgactgggacgccggcgggctgggctttaagcgctcctgctacgtggtcggcggcggcaagcgcgagcgcgggccggaccaggagcgcaagaagggcgtcccctggacggaggaagagcacaagcagttcttgatgggcctgaagaagtacgggcgaggggactggaggaacatctcgcgcaacttcgtgacgagccggacgccgacgcaggtggccagccacgcgcagaagtacttcatccgcctcaactccggcggcaaggacaagcgccggtccagcatccacgacatcaccaccgtcaatctccccgacgacgacgcgggcggtaccgcctctgcctctccgccctccgtgctcacctccgcctccgcgccctcgtccaccggcggcggcggccctgtcgtctccgagcagttcggcgtgctcgtcgacagcaagcccccggcgccgcaccaccacttcgtgccgcacccttacggcaacgtgaagctcgagcccgtcagttcccaccacggtgggttcctggacgactctgtcctgatgcagatgcactgcgggcagctgcagcctctcggatgactggttgtttgtgcagcaacaatggtagaaagagggaaatgcctctcgtctctttggccagttacgaggggtggagggtaccataccgctctgttgcgttgcgcgtgtctgttgttggatttcaatcaggcaaataacaattgggtacagcacacattcttgtcaagggtggatggctcatacaaacagctccgaggcccgagctcagcgcagctcgcagccgagcgctagcgttctgctgcagctgaagccactgaactgagctccctcccgtgtgttccagagacgggaggaagagggtgaaaaagaaaagaaacacacacacacacacacacacaaaaagtagaagatatggacaatgggatctctgcatttcggctatgcatgtgtatacataagcccacgcccgctgtgaaataatttcctactgtgatttgtttcccgtgttatgggaaccacactgctagatgttgtgattgattacgctagctagccctttctttgtagtaatgaggtattggtcggttaacgtcatgtatttcgacagcgagtagcatcagcagcatgctgtctggtgtcttgtaatggttttttatctttataagctggggatgtatc

SEQ ID NO: 7365 - DNA, 781 bp, Zea mays
actccactcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaatgttcccccatgttctgtttctcgttctgattctgcaattcgtcatattgttgaatttaatggttatgtggaatcgct

SEQ ID NO: 7366 - DNA, 2671 bp, Zea mays
gcgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctgttatgggcttcctgcttgcatcaagtgggcttgtggttctgtacatcaccattaatgtatttaagttgtattacggtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgccggtgccctggtttctggagtgcagattgccatctctgcttccaacaccggtggtgcatgggacaatgctaagaagtacattgaggctggtgccagcgagcatgccaggaccctcggccccaagggatctgactgccacaaggctgctgtgataggtgacaccattggtgaccccctgaaggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagccgcctagctgcactgctgtttttttggtctcattgttcgtattttctccttggcccctccccctagaggcgttactgttagccttactcttactccctgtagctgcacgtagaagagaactgttgtcctgcaggtctggcaaattttcccagtctcttgatgatggcgatgatgttgaaatctttgaacaatgatacatgattgttgc

SEQ ID NO: 7367 - DNA, 960 bp, Zea mays
ctcacaaaaaccctcgctccccacaacccgccgccgcccacgccgccgcctgtactagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgctggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggaatgggtggtatgggaatggatgattttgaggatgatagtgatgaagaagaagtatcgaaacctcaagctgccggacatgctgctgaggccgagaagactgagtcggcggaagccaagactgagtcggctcagagcagttgaagatgcttccgacatgatctaaactagttgtatcgtcaagttaattctgctgaatcggtggacaaacttctacgttgtggcactggccgatcccagtgacttgccctaaaatttacgttctgtctttacatgggcatcctagtgttgtgctcatcacattattgatattgtttctgtgatgcttcctttggtcgacaatcatgtgctggagtttgtttactggattgcttttcttctgtggtttttggctttatacctgtatggaaagctggagccgcaaatggagaaatagggaacgacgtgtatttttgtt

SEQ ID NO: 7368 - DNA, 1088 bp, Zea mays
cgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagcttttaaagtc

SEQ ID NO: 7369 - DNA, 1564 bp, Zea mays
ccgccgcggagacgctcccgatggagctggatccgtcggaggccttagttgccgctgcggtggaggcgaagggcgaggaggctgccaacgggaggagggagttcgtgatggggaggaacgtacacacctcctgcttcgccgtgaaggagcccgacgcggacgacgaggaaaccggcgagcgggaggcaaccatggctagcgttctcgcgctctaccgccgctcgctcgtcgaacgcaccaagcaccacctcggttacccatacaatctggactttgattatggtgcactgacccagctgcagcacttctcaattaacaaccttggtgatcccttcatcgagagcaactatggtgtccattcccggcagtttgaggttggagtgctggattggtttgctcgcctctgggagttagaaaaggacgagtactggggatatattactaactgtggtacagaaggaaatctgcatgggattcttgttgggagggaggtgttccctgatggaatattgtatgcttctcgtgagtcccattattcagtattcaaagcagcaagaatgtacagaatggattgtgtcaaagttgacacccttatgtctggggaaatagattgtgctgatttccagagaaagttattgcagaaccgagacaaacctgccatcattaatgttaacattggaacaactgtgaagggggcagttgatgatctagacttggttatcaaaacccttgaggaaaacggctttaaagatcggttttatattcattgtgatggtgccctttttggattgatgataccatttgttaagaaggcacctcaagtgacatttaaaaagcctattgggagtgtcagcgtctctgggcacaagtttgtcggatgccccatgccatgtggtgtccagataacaaggttggagcacataaatgccctttctagcaatgtggagtatctggcgtcaagggatgcaacaatcatgggaagcaggaatggtcatgcccctatcttcctctggtacaccctcaacaggaagggctacagaggcttccagaaagaagtccaaaagtgcttgagaaacgcgcactacctaaaagatcgcctcaaggaagcaggaatcggagcgatgcttaacgagctcagtagcacggtcgtgtttgaaaggccaaaggatgaagaatttgtccgaaggtggcagctggcttgtgaagggaatattgctcacgttgtggtgatgcccagtgtcaacattgacaagctagactatttcctgaatgagttagttgagaaacgagcgacttggtaccaggatgggataagccagccaccctgcattgccagagacgtaggtgttgagaactgtctctgtggccttcacaagtagcgagccttttgctttgcaagtgggttcattcttgagtcgagttaaaagtgttatgttgtactgtgttcattcttgagttgagttaaaaagtgttatgttgtactgtgtccatgcgttctgcttctgtgttgtccacagtgtagcttatttgttgccatgggaataaaattccttctattaaattg

SEQ ID NO: 7370 - DNA, 2245 bp, Zea mays
gcaaggcaagtagccgctgcgcggtgctgccacctgacctgactgccgtcccggtccccggtccatccgaacgccgttacggggccgcccaccgcgacggaacggaaaggtgcggtcaacccaccccgtcccagtcccatcaccgccgggggccgggtggataaacaaacccagcggccccggccccctgtccgcctcattcccttccttcctttgctcctcccctgcctcgcctctctcccctctcctcgcctccagctcctgctcggcccgctcgcgtccagctgcgcgcgcgcctgcggtggccgtgaaggacagcccgagggacgcgccgggtgcactgatctgggggccgcgtgtccccggtggtggggcgaggcggcgccggcttccaggaatgggcagcttgtagtggctgtttcttttgcatatgcgctttctattgttgttgtcatttcaaaggaggccatagtctcctggattttgtatgccttgttatctggaattggtgaccatagatgtcatttcgtagcatagtccgtgatgttagggatggcttcggcagcttgtcaaggagaagctttgaggtgaccctcgcaagcatttatggccttactgggcatcacaaagggaagacccagagctcatcacatgtgctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgttcctggcagcagcgctcgcttctcgggcattgctggcgccagactggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacatcaggttgcttgcattaggccatcagtgtacctctttccatctggctctcgtgttgccttggttgtatttgtgcttaatgtagccatgaatttggtggcccatatatggacgcatgtgttgttgttggccctctcccttagaagtgattaaaagttgcatttggaccacatgttacccgatctgtaatatacttgcagtggcatcgcatgccgcgtgataacaaagttcccgttcgtgattggacttgtatggtt

SEQ ID NO: 7371 - DNA, 1244 bp, Zea mays
gagcaagcccagtccccaatcccaccctgccacccaaccttgcttcttctccgatagctatttctctggtttctccccaatcttcccgggtttccctgattaaagatggctgagtcctttgttctcaataccggctcgaggatcccatcggttgggcttggcgtatggcaaatacaacctgacgctgccaacgacgccatctacgctgctgtcaaggctgggtatcggcatattgactgtgcagcagcatacaacaatgagaaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctctgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctctgaaatcaaacaggtcaggctgctgacagctgagtttgtagttcaccctcaggctggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgttgaacacaagcattgtgtgactaatctgtgttttgatgtggtaaatgtaattgggttagtcacaataagagataagtgcctttgccac

SEQ ID NO: 7372 - DNA, 1537 bp, Zea mays
cccgtgcgggttggttggatccgagctctgtgcagaagcgccgccgcgacacggtcgaattccactggatccagctgctgaacggggtaccagaaggtggatttggtagtagcactgaacagcgagtggaatttctctaatactgtccaggatcatggttcctctctgtggtttctgtgggaaacaaaggtcaatgatctactgcagatcggatgcggcatcattgtgcttatcatgcgaccgtagcgttcattcagctaatgcactgtctcggcgtcatagaaggacccttctttgtgatcgttgtggtttacagcctgcatcagtccgatgtcttgaggacaacacatcactttgccaaaactgtgattggaatgggcatgatgcagcatcaggggcttctgggcataaaaggcaggccataaactgttactcagggtgcccatcatcagcagagctttcgagaatctggtcatttattatcgatatcccgactgtagctgctgagcccaactgtgaggatgggctaagcatgatgacaattgatgacagtgatgtgactaatcatcacggtgcttcagatgataaacgattgttggaaatagctaacacagcactcatgagtgatccaccttcacctgacaagcttaaacctctgataggctcttcttctggagatgggtttgatgttctgcctctagccacagatcagcctgctggaccagtttcagcgacacctaaggtaccttatgccagagatgacaataagttcaatgatggcatgtatgaagacttatgtgtggatgatgctgacctgacattcgagaattatgaagagctattcggtacctctcacattcgaatagaggaactctttgatgacgccggaattgacagttactttgaaatgaaggaaacaccgccttttgatttcaatgagcccaaaattgtgcagctacaatgtagcgatgtggtaccagctgattgtgcgatgtcaaacacaggggaaagggctgattccagcctttgtattcctgttaggcaggtcagatctagtatatcccatcccttatctggtttgactggtgagagcagcgctggagatcaccaagactgtggggtgtcaccaattctcctcatgggcgagccaccctggtattctcctggtccagaaggctcattagctggaggaagcagagatagtgctctcacacgatacaaggagaagaagaagaaaagaatgtttgacaagaagatcagatatgcttctcgcaaggctagggcagacgtgaggaagagggtcaagggacggtttataaaggctggcgaagcgtatgactatgatccactaagtcaaactagaagctactgagactgctgagccttgaatgcggctgcttgttgatcgtccagtgtcagcctagcaaatcttcaacggctcgtctgttgtaggtcgttgcgctacaggcaagattactggagagcacagcgattgcaaatttgcaatgcacgcatcagagcctgcagttgaaatacg

SEQ ID NO: 7373 - DNA, 1075 bp, Zea mays
cagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttgggaaaaattggttttcgttccaagtttgttt

SEQ ID NO: 7374 - DNA, 1159 bp, Zea mays
gcaatggcgaagctttggacattgctgctggctgcagtggtggtcctctcactcctagtgagccccattgcttgcacccgaaagctcaacaaacccaagccgaagccgggcagctacaggcggccggtcaagccgaagccaaaaccggtcacgggcagctacaagccggcgcctgtggccgccagaagaaaccacacagctacacccacgccatcgccgactgtctacggccccggtggctggctgtcaggcgccggcgccacgtactacggcgcgaccaacggcgacgggagcgacggcggcgcgtgcggctaccagacggccgtcggaaagaagccattcgactcgatgatcgccgccgggagcacgccactgtacaggggaggcgagggctgcggcgcctgctacgaggtgaaatgcacgaccaacgccgcgtgctccggccagcccgtgaccatcgtaatcaccgaccagtcccctggcgggctgttccccggcgaggtcgagcactttgacatgagcggcaccgccatgggcgccatggcccggcccggcatggccgacaagctccgcgctggcggcgtgctcaggatcctgtacaggagggtgccgtgcaagtacaccggcgtcaacatcgcgttcaaggtggatcagggcgcgaacccgtactacttcgacgtgctcatcgagttcgaggacgacgacggcgacctcagcgccgtggacctcatggaggccggcagcggcgtctggactcctatggcgcacaactggggcgccacgtggcgcctcaacaacggcaggaagctcaaagcgccgttcgggctccggctcacctccgactcccgcagggtgctcgtcgccaacaacgccatcccggccgcgtggaagcccggcaagacctaccgctccttggtcaactacccctgaaaagagaaataccgacaagtggatggcgtgtattgtgcgtccgggtgttgcgagtggcggcggtgtactactggtgtcggaaaacagaagagaatgaaagaggaggttgaagaagagaataatgtccttcttccctccctggacggtctctgcagtccccaaaagtgatgtgtgacggtgttagtcaaatcatgccggtaatttgatacttcatctcgatttgagtttt

SEQ ID NO: 7375 - DNA, 1268 bp, Zea mays
cacgccacgccaaccccgggctcaactcgagtccacacgccccagcaccacccctgcctctcagtccagtcccccacccaccaccaccactcctcccctcgccgccgcccgttcccgaccgatccggccggatcgccccgccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagcaggatatggatggatggatgaaccgtttcccctcccctgctccctctgtaaattacggtagcagccgcgatgcttggggccggcgagtacccccgtctgggcggccgttgagttatgtgtgttactctatagtatgactaagctggagtgcctcatgtccaccatgcagtgcagctttttttctccgacttttttttgctgcgtagagaaatgagatgagaaatgtgatccagagatccttgtgcc

SEQ ID NO: 7376 - DNA, 2220 bp, Zea mays
ctcgtagatcccgccgcctcccgcgtctagccgtcgacgagcaccgcagcctgacacagccgcgggcgaaccatcgcgtgcggcctcgcccgggatggcgaccatggagagcctgatcgggctggtgaaccgtatccagcgcgcgtgcaccgtcctcggcgatcacggcggcggcggcggcggcgagggctccctctgggaggcactcccctccgtcgctgtcgttggcgggcagagttccgggaagtcgtcggtgctcgagagcatagtggggagggacttcctgccccgtggatctggcattgtcacgaggcggcctttagtgctgcagctccacaagacagatggtgggcacgagtatgctgagttcctccacgccccgcggaagcgtttcaccgactttgctgctgtgaggaaagagattgctgatgaaacagatcgcataactgggaaaactaaagctatttcaaacgttcccatccatttgagtatatattcaccacatgttgttaacttgacacttatcgatcttcctggactgacaaaggtcgctgtagaggggcaaccagaatctattgttcaagatattgaaaacatggttcgagcttatgttgacaagccaaattgcatcatcttggctatctccccagctaaccaagatattgcaacgtcagatgctatcaagcttgctagggatgttgatccttcaggtgacaggacttttggagtcttaacaaagcttgatttaatggacaagggtaccaatgctgttgatgtgcttgaagggaggcaatatcgcttacaacacccctgggttggaattgtcaatcgctcacaagctgatatcaacaagaatgtcgatatgctctcagcaagacgcaaagaaaaagagtactttgagagtagtcctgaatatggtcacttggcacataaaatgggtgcagagtatcttgccaagcttctgtcacagcatttagaggctgtgatcagggcaaaaattccaagtattatagctatgattaacaaaacaattgatgaaatagaagcccagttggatcgacttggtaggccaattggaggtgacgctggggctcagttgtacacaatcttggatatgtgtcgggcatttgaccgtgtctttaaagagcacttagatggcgggcggccaggtggagatcggatttatggtgtctttgacaaccagttacctgcagcactgaaaaagcttccatttgaccggcatctttcaatgcaaaatgttcgcaaagttatttcagaggctgatggttaccagccccacttgattgcccctgagcaaggatacagaaggcttatagatagttctctaagctactttaagggtccagctgaagcatctgttgatgcggtccatttggtcttgaaggagcttgttcggagatctattgcagcaacagaggaattgaagcgattcccaacacttcaatcagatatagctgctgctgcaaatgatagcttggaaagattccgtgaggatggacgaaagactgttcttcgtctagttgagatggaagccagctacctaacagtagagtttttccgtaaacttcctactgaaccagagaaagcagctgataagaacactccagtgagtgataggtatcaggacaatcatctcagaagaatcggatcgaatgtgtcatcttatattaacatggtctgtgagactctgaggaacacggttccgaaagccatcgtgcattgccaagtgaaagaagcaaaaagaaatttgcttaaccgtttctatgctcatgtgggaagcaaggagaagaaacagctgagcgcgatgttggatgaggaccccgctttgatggagaagagggatgccttggtcaagaggctagagctgtacaaatctgcaaggaatgagatcgactcggtcgcatggaaatgattggcttgtgacagctacatctggaatgtatgtaaaatgtacaaccgcagcagcacacgtgtgattgcagtagaatgttcaattcttttttacatttgaatttactctggaggccttgtacgcagttttcactcgagtctttgccggacatgcttatttggccgtcttggccttaacacgattgtgttatgcgtggatgatctggtctccggttgatataagagtgtatatgtattcttttgttgattttattactgccttgatgatatcaatagtttttaccacag

SEQ ID NO: 7377 - DNA, 975 bp, Zea mays
ggtgtctcgatccgacttggtacttggcggctccactgctcacgtcacgtgccgcccgcgttctctctccgactcccatgcctctccggtgagctagtctggtatccatcggcgagctagttttgtctccaccggcgagcacgcgtctgtaacctcctccacccccatcgaactcctcctgctctccaatccgctagatctcggctccgtgcagctatgctgattgtgaggaatttggtagcacctctatcagggtttttaaactagagtgctgccgccccagcatacataatatggacgaagaaaatgttgttgagctgctgcaacgttatcgccgtgaccgtcaagtattactcaactacattctttctggcaacttgatcaagaaagttgcaatgccacctggtgcaatctctttggatgatgtagatatagatcaagttagtgttgattatgtcctcaactgtgctaagaaaggtgaacctcttgaccttggagacgccatccgcctttttcatgatagccttgactatccatatgtgaataacactggagctgtggatgagttctatttgcttacaaaaccagaatattcaggaccagctccaacacgagaaccaccacctatcccagccactgcaccatcatcagttgtggtaccaccaccggatgtggaaccagcaccaattattgtgtcatcgccagtcacagctaccaacttgccaaaatcacaaccatttgattctccgaccgagaaggagttaactatagatgacattgaagactttgaggatgatgaagatgaatttgatgggcgaagggcttctagaagacatcaaactgacgccagtgatctatcgttgctgttaccactatttgaaacaggtatcacagataatgatcttcgtgagacagcatatgagatccttgttgctgctgctggtgcttccgggggtcttatagttcctcagaaag

SEQ ID NO: 7378 - DNA, 1103 bp, Zea mays
caactccccaccccagccgatcccaacgcacactgcacccagtgcggcggccgccggcaatggcggtgcacggcggcgactacttgcggcggttcgttgcggagacggagtggtacaacgaggtcgtcctcaacgccgtggcgccaggcgactggtggcgcggcctgccgcacccggtgcagtcgtggatgcgcaactgtgtcggcggttacctcctctacttcatctctggtttcctctggtgtttcgtcatctactactggaagcgccacgcctacatccccaaagatgccatccccacaaatgaagctatgaagaagcaaatagctgtagcatccaaggctatgcctttttactgtgctcttccaactttatctgagtatatgatcgagagcggatggacccggtgttactttaatatcagcgaaatgggtttttctgcgtacctttgttatatggctatgtatctcatttttgtggagtttggaatttactggatgcacagagagttgcatgacataaagccactatacaaacatctgcatgcgacccaccatatttacaacaaggagaacaccttgtctccgtttgctggactcgcgtttcacccactggatggtattctgcaagcgataccgcatgtgcttgcgctcttcctcctcccaacgcacttcaggacgcacatcgctctcgtgttcttggagggcgtgtggacgacaaacatccacgactgcattcacggcaaggtatggccagtcatgggcgctgggtatcacaccatccaccatacgacttaccgccacaactatggccactacaccgtctggatggactggatgtttggtacgctccgtgagccagatgatatcctcaagaaggcctgagttcgtcgtagctgtggttttcctacggtgctggatgtgcttggtctgttctgtccccagtgcctctaatccgctgagcctgttcagcgctctgtttctgtaggctttggtgtgctatttagtttgctaggtttatatgttgtgcttattctgtaatttagtgatgtttgtctgatgacgcaacggagttcaggacgaataaagaaagatttgctagac

SEQ ID NO: 7379 - DNA, 1698 bp, Zea mays
ctggatgaacgaccccaatggccccgtgtactacaagggctggtaccacctcttctaccagtacaaccctgacggcgccatctggggcaacaagatcgcgtggggccacgccgtgtcccgcgacctgatccactggcgccacctcccgctggccatggtgcccgaccagtggtacgacaccaacggcgtgtggacggggtccgccaccacgctccccgacggccgcctcgccatgctctacacgggctccaccaacgcctccgtccaggtgcagtgcctggccgtgcccgccgacgacgccgacccgctgctcaccaactggaccaagtacgagggcaacccggtgctgtacccgcccccgggcatcgggcccaaggacttccgcgaccccaccacggcctggatcgacccctcggacggcgcatggcgcgtcgtcatcggctccaaggacgacgacggccacgcgggcatcgccgtcgtctaccgcaccacggacctggtgcacttcgagctcctcccgggcctgctccaccgcgtcgacggcaccggcatgtgggagtgcatcgacttctaccccgtcgccacacgaggcagggcgtcggccaacggcgtcgacatgtccgacgccatcgccagcaacggcgccgtcgccggggacgtcctgcacgtcatgaaggccagcatggacgacgaccgccacgactactacgcgctggggaggtacgacgcggccgccaacgcctggacgccgatcgacgccggcagggacgtcggcatcggcctgcgctacgactggggcaagttctacgcgtccaagacgttctacgacccggccaagcgccgccgcgtgctgtggggatgggttggcgagacagactcggagcgcgcggacgtgtccaagggatgggcgtcgctgcagggtatcccccggacggtgctcctggacaccaagacgggtagcaacctgctgcagtggcccgtggaggaggtggagacgctgcgcaccaactccaccgacctcagcggcatcaccatcgactacggctccgtgttcccgctcaacctccgccgcgccacccagctggacatcgaggcggagttccagctggaccgccgcgccgtcatgtcgctcaacgaggcggacgtgggctacaactgcagcaccagcgggggcgccgccggccgcggcgcgctggggcccttcggcctgctcgtcctcgccgaccgccgcctccgccgcgagcagacggccgtctacttctacgtggccaagggcctggacggctccctcgccacgcacttctgccaggacgagtcccgctcctccagcgccaccgacatcgtcaagcgcgtcgtcggcagcgccgtccccgtgctggaggacgaggccacgctctcgctccgggtgctcgtcgaccactccatcgtcgagagcttcgcgcagggcgggaggtccaccgccacatcgcgcgtctaccccaccgaggccatctacgccaacgccggcgtcttcctcttcaacaacgccaccgccgcgcgggtcacggccacgaagctcgtcgtccacgagatggactcgtcatacaaccacgactacatggcgccggtggcagacatctgatcgatgcaatgcaaccacgccactctgcaccgcaacaaattttccaacacacataaatataccaagcaattcccatc

SEQ ID NO: 7380 - DNA, 1817 bp, Zea mays
atctgtcactccccgacacgcgcacgagctccactccccactccgcacccaacccaaggcgccactgccatggacgcgggcggtccgccgccgctgttcctcctgggcgccgtgctggccgcggcgctggggtggctgctcgtggtctggcgggcggcggcggggcggcggcggtccgcgtcggcgcggctgccgccggggagcacggggctgccgctcatcggggagacgctgcggctcatcgcggcgtacaagtcgccgaacccggagccgttcatcgacgagcgcgtggcgcggcacggcagcggggtgttcacgacgcacgtgttcggcgagcgcaccgtgttctccgccgacccggccttcaaccgcctgctgctggccgcggagggccgcgccgtgagctgcagctacccgtcgtccatcgccacgctgctgggcccgcggtcgctgctgctcacctcgggccccgcgcacaagcgcctccactcgctcacgctgacccgcctcggccgcccggcctcgccgccgctgctggcgcacatcgaccgcctcgtcctcgccaccatgaggggctgggaccgccccggcgccggcgccatgcgcctcctcgacgaggccaagaagatcaccttcaacctcaccgtgtggcagctcgtcagcatcgagcctgggccgtggaccgagagcgtccggcgcgagtacgtgaagctcgtcgacggcttcttctccatccccttccccttcgcctccctcctcccgttcaccgtctacggccaggccctcaaggcgaggaagaaggtggccggagctcttcgggaggtggtaaggaagaggatggacgacaaggcggaggacgactgtggcgccagtaagaagaacggggagaagaaggacatggtggaggagctcctagaagcggagggcgggagcttctccgtggaggagatggtggacttctgcctgtccctgctggtggctgggtacgagaccacctccgtgctcatgacgctcgccgtcaagttcctcaccgagacacccaccgcactggcgcagctcaaggaagagcacgacagcatcagaggggtaaaaggcaaaggccaagctctggaatggagcgattacaagtcgatgccgtttacacaatgcgtgataagcgaaacgctgcgcgtggccaacctgatcagcggggtgttcaggcgtgcgaacaccgacatccacttcaaaggccacgtgatcccaaagggctgcaagatcttcgcgtcgttccgagccgtgcaccttagcctggaccactacgagaacgcccggaccttcgacccttggagatggcagcagggcaagagcaagctgcagagcgcggaaggggccagtctgttcacgccgttcggcggcgggccgcgcctgtgcccgggctacgagctcgcccgggtggtggtttccgtcttcctccaccacctcgtcacgcgctttagctgggaggaagccgaggaggacaggattgtcttcttccccaccacccggaccctcaagggataccccatcatcctacggcggcgaccggattgcgatgatctctgacctcatggctaggttccccccttatcttcttcggatcaaggctgaaggctaagcattagatagagtaaggtggatgtcgtcgtggctagtaggtgcatggtggtttctgccactcactcactcactcactctgttgtctgtttgttcctgttcctctctgttttctcttgctctgtaacctggacctggtacgagtcagcactcagcagccagcagcaaactcgcgttttgcttgt

SEQ ID NO: 7381 - DNA, 1873 bp, Zea mays
ctctctcatctgtaggatgtaaaaaactcagccaggaaagctgctgaaactgttctgttggttattgatgaggaaggagttgaaactttgatacctgagcttctaagaggaatcactgacagtcaggcatcaatgaggcggggctcagcctacctaattggtttcctctttaaaaacactaaactatatttggctgatgaggcttctgatatgatgtcaaccctaataattttgttgagtgatacagacaaggctactgtatcagctgctttagaagcattttcaagagttgttgcatctgttccaaaggaacagctcccaacacacataaaactagtgcgcgatgctgtctctacagccagagataaagagcgtagaaggcgaaagggtgtgcctattcttctgcctggcttatgtctttctaaagcactgcaaccttttcttcctatatttcagcagggtttaattagtgggtcggccgaaacaaaggagcaggcggctgaaggtctaggagagttaattgatgtaacaagcgagaagactcttaaggaagttgtagtgccaattacaggacctcttatccgcatccttggtgatcggtttccatggcaagttaagtcagcaatcctatcaaccctgacaatcatcatcatgaaaggtggaattgcacttaagcccttccttccacaacttcaaactacattcgtgaaatgtctacaggataacaataagtctgtccggacgagggctgcagctgctctcggaaagcttagtgctcttagcacacgggtggatcctttagttagcgatcttctgtccatgttgcagtcaggagatgaatctgtaaaagaaagtgtgctttctgcactcaaaggtgttatcaaacatgctggcaaaagtgtcagtgctccaataaggtcacggggatgtgctcttcttgaagatctgctgcaggctgaagctgatgatatccgcagttgtgctgcaaaagtgattggcacattgtctcagtacatggatgacagagagattccagatttggtgcaaatccttttggaagtgggcacctcatcggactggtgtaccaggcatggtgctttgttagcattatcatccatatcaatgcattctccatcaaaattatgtgatttggcatcctttccatctctggttgatcttctgaaagattctcttaaagacgacaagttccctgttcgtgaagttgctacaagaactctgggaaggatactcgttttcgagctacagtcagaagctgacaccttgcaacttgttcagttgcttgtcttggccttgcgtgatgattctagtgaagttaggagaagatctttgtcgtgtatcaaagctgctgcaaagatgaaccattcagctcttgctacacatcactctatattgggcccggcaattgctgatgctttgaaggactctagcatgcctgtacgtctagcagcggaacggtgtgcccttcatgttttccagttgactaaagggccagataatgttacaacagcgcagaagtacctaggcatgactggcttggaagtgaagaaaatcgcaaagcttaacgaggagagtgatggcagtgagagcagtgatgatgacaggaggacatgacctctactcacagcaagcttgtatcggttcagttattatgatctttatatatagttaggcaagttagctacattgacagtggaaggtggggtcattttttgttctgtctgacccattttgtgaacatcctttttgacaacaaatactggcagaggaagacacgtcggcatttgtcatattttgttgcggcaaaccgacaatgtttatggaaaccaacaatttttgttaaagttattcaatc

SEQ ID NO: 7382 - DNA, 1627 bp, Zea mays
ggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctat

SEQ ID NO: 7383 - DNA, 1807 bp, Zea mays
gcaagaagctgtccctccctccctcccctgtgcttctgctagctaggtgcctgcggaggagagatagggatacgatggccggcggtggcatcgtgaacacgggcggtggcaaggactaccccggcaagctcaccctcttcgtgttgctcacctgcatcgtcgccgccaccggcggtctcatcttcggatatgacatcggtatctcaggcggcgtgacgtccatgaacccgttcctggagaagttcttcccggaggtgtaccggaagaagcaggaggccaagacgaaccagtactgcaagtacgacaaccagctgctgcagaccttcacctcctccctctacctggccgcgctggtcgcctccttcttcgccgccaccgtcacccgcgccgtcggccgcaagtggtccatgctcgtcggcggcctcaccttcctcgtcggagccgccctcaacggcgccgcccagaacatcgccatgctcatcatcggacgcatccttctcggcgtcggcgtcggcttcgcaaatcagtccgtgcctgtgtacctgtcggagatggcgccggcgcgtctccggggcatgctcaacatcggcttccagctgatgatcaccatcggcatcctggcggcggagctcatcaactacggcaccaacaagatcaaggccgggtacgggtggcgcgtgagcctggcgctggcggcggtgccggcggccatcatcaccctgggctccctcttcctcccggacacccccaactcgctgctggagcggggccacccggaggaggcacgccgcatgctccgccgcatccgcggcacggacgacatcggcgaggagtacgcggacctggtggcggccagcgaggaggcccgccaggtgcgccacccgtggcggaacatcctgcgccgccggtaccgcgcgcagctcaccatggccgtcgcgatccccttcttccagcagctcacggggatcaacgtcatcatgttctacgcgcccgtgctgttcgacacgctgggattcaagaacgacgcctccctcatgtcctccgtcatcacgggcctcgtcaacgtcttcgccaccgtcgtgtccatcgtcaccgtcgaccgcgtcggccgccgcaagctgttcctccagggcggcgcgcagatgatcgtgtgccagctcatcgtgggcacgctcatcgccgccaagttcgggaccagcggcacgggggacatcgccaagggctacgccgcggtcgtcgtggtcttcatctgcgcctacgtcgccggcttcgcctggtcgtgggggcccctgggctggctcgtgccgtccgagatcttcccgctggagatccgcccggcggggcagagcatcaacgtctccgtcaacatgttcttcaccttctgcatcgcgcaggccttcctcaccatgctctgccacttcaagttcggcctcttctacttcttcgccggctgggtcgtcatcatgaccgtcttcatcgccttcttcctgcccgagaccaagaacgtgcccatcgaggagatggtgcttgtctggaagtcacactggttctggaaaaggttcatcgccgacgaggacgtgcacgtcggcattggcaacaaccacccggccaaaaacggcagcgacaccaagggggccgacgcgtgaacgtgatctcaacatctatattccatctacagtcacaactgaaatgtacatttaggcttccattgttccatcaactagtagctacatgtcctcctagtaaagtaccagtgtttgtttgtgtaatgtttgttacgcccattaaattcttcttggattggatg

SEQ ID NO: 7384 - DNA, 1478 bp, Zea mays
gacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcg

SEQ ID NO: 7385 - DNA, 1042 bp, Zea mays
gcaaagagtgggccgggtggccaggaccaacgacttttccatagtcgtgctcgtcttcgtccacctcccgacccgactgagtagcaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctctactttggcctcctggttttcctgggatatatggtgtttgacacccaggagatcatcgagagggcgcaccgtggggacatggactacatcaagcacgcgctgactctcttcaccgactttgttgcggttcttgttcgaatccttgtcatcatgatgaagaatgcacaggagaaatcccaagacgagaagaagaggaagaagcggtagctgctgaatgaattggatgacatatgttgttgtggtcactacttcatagtaccgtgtactcctatcctattgtactaataataataatagtaagacgaaagatgactgctgggaatgaatatttggttctgct

SEQ ID NO: 7386 - DNA, 832 bp, Zea mays
ctcaacagcaacagctaagcctctcccacaagacagcaacatggctgaggaggaggccaagaaggtggaggtggaggtcaccaaggagcccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtcacgctgttgttgttgttgttgacattcaagcagacattttgtttt

SEQ ID NO: 7387 - DNA, 1227 bp, Zea mays
cgccgctccccctccctacgcaagcttcctccccctccgcgccgctcctccaggttccagccatggcgatcgccaccgagtcgcgcggcagcgaggacagggcttcagcccatgcaaacgaggagaagcggtgggtgctgtctgatttcgaggttgggaagcctcttgggaggggcaaattcggccacgtatatcttgccagagaaaagaggagcaatcaaattgtggctttgaaagttcttttcaagagccagcttaagcaatcacaggtcgagcatcagctgcgacgcgaagtggagattcagagtcatcttcgtcatcctaatattcttcgcctgtatgggtacttctatgatcagacccgggtttacctaatcctggaatatgctgccaagggtgagctgtataaggaactgacaaggtgtaaacatttttctgagagacgttcagcaacttatattgcatcattggctagagctctgatctacctgcatgggaagcatgttatccatcgggacattaaaccagaaaatcttttggttggagcccagggtgagatcaaaattgccgactttggctggtctgtgcataccttcaacagaagaaggactatgtgcggaaccctggattacctgccacctgaaatggttgagaagacagaacatgattaccatgttgacatatggagcctgggtattctgtgttatgagttcctttatggggtcccaccttttgaagctaaggagcactcagaaacatacagaaggatagtaaaagtcgacttgaagttcccactgaaaccattcgtttcgcccgccgcaaaggatttgatttcccagatgctggtcaagaactcggcccagcggctgcctctccacaaggttcttgagcacccatggatcgtccagaacgccgacccttccggtgtgtgcagaggatagaaccaccaccaccggctgaagggagtgcgattctttccactctccccatttcgaggggagtgcgattctttcgactgtttatggcttctgtcgcccgaattgccccaccccgaactgtatcttgtagcaccgtgtactgtgtagttggggccgtgggcaaattgccctgtaccctcgaacaaccttctttactcgtagtctcgtatgagagagccttgtagagtctcgtccgtccaattatgaactcgagggcaatgtgcaggaaaatgttgaaggtatcgtccat

SEQ ID NO: 7388 - DNA, 1206 bp, Zea mays
gcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaatggctggtctcagtggtctatacgtatgctttttggtt

SEQ ID NO: 7389 - DNA, 916 bp, Zea mays
ggagagctgggtgcttccacgcccacgggcacgctgatccctgcaacagctccagcaccccgtacatgatcctcttcggcgtcgtgcagatcctcttctcgcagatacccgacttcgaccagatttggtggctctccattgtcgccgccgtcatgtccttcacttactcttccatcgggctctccctcggcatcgcacagaccatctccaatggtgggttcatgggcagtctcactggcatcagcatcggcgccggtgtcacctccacgcagaagatctggcatacgcttcaggcattcggagacatcgccttcgcctactccttctccaacatcctcatcgagatccaagacacgatcaaggcaccgccaccgtcggagtccaaggtgatgcagaaggcgacgcgcctcagcgtggcgacgaccaccatcttctacatgctgtgcgggtgcatggggtacgcggcgttcggcgacaaggcgccggacaacctcctcaccggcttcggcttcttcgagccgttctggctcatcgacatcgccaacgtcgccatcgtcgtgcacctggtcggcgcgtaccaggtgttctgccagcccatcttcgccttcgtcgagcgccgcgccgccgcggcctggcccgacagcgccttcgtctcccaggagctccgcgtgggccccttcgcggtcagcgtgttccgcctgacatggcggtcgtccttcgtgtgcgtcaccaccgtcgttgccatgctgctgccgttcttcggcaacgtggtggggttcctcggcgccgtctccttctggccgctcaccgtctacttccccgtcgagatgtacatcaagcagcgccgcgtgccgcgcggcagcaccaagtggatctgtctccagacgctcagcgtcagctgcctcctcgtctccgt

SEQ ID NO: 7390 - DNA, 2987 bp, Zea mays
catctgcctgccccccctcggccgccggcggcggcgatcgcgggtagccgccccaaccggccgaggttgcatagaggtgctggtatcttactctgcttctggttatgctatctgcctatgacttcagcttcccaaacttctccctgcttcttgcccctggttggtaaaaatctgtaacaactgctgccctgactgcaaaagacgcaactatgcgtctttcttcttctcttcaagatttgccgaccttcaccagaattgatgctttggaaaggggttctagcgtaggcagtgatctgagctcagggcgcccaaaacctgtccgcatgcttcaaagagatggtgccgtcgcaagcttttcaaaagaaagaacacccccctcatcgccgacaaatagaaagaaatgcatgagagcagccgggtgtgctattgcattgatcttactggtgttctttgcgtatggttcatggagatattttcatgtgttcctctctgaaggaagatctgaatactatgttgttcttgattgtggcagcactggtacgagagtttatgtctatgaatggcatattaatcataatgacgcaaatgcatttcctattgttttgaaacctttagggaatgctcccaagaagaaatctggtaaattaacccgactatatcagcgaatggagacagaacctggattgagcaagctcgttcacaatgaatctggattgaagaaggcaatagagccccttcttcagatggctgagaaattgatccctagacatgcacacaagcacactccactttttctatatgctactgctggtgttcgcaagctacctagtgcagattcagagtggctcctggataagtcctgggatatcctgaacaattcatcatttttatgtagtagagatagagttaagatcattagtggcatggatgaagcttattatggatggatagctcttaaccacaacatggatatgcttggcacctcatcatctaaaatgacatatggttcacttgatttagggggatcatcattacaggttacatttgagaatgataaatcagtgcaggatgagacaagcattcgtctgagtattggttcagttgaacatcacctcagtgcttattctcttactggttatgggttaaatgatgcatttgataaatctgtagcacatctagtgaaaagactgggaggagttgctagcaatggcaaggttcaagtcaaacatccctgtctacagactggattcaaggaagattatatttgttcttactgccatccattgaaacaagatggaagtcccagtgtcggcgagaagaacagtggcaaagagaagcagggaatagctgttgaactggtcggagcacctcagtggaatgaatgtagtgctcttgcaaaagtaacagtcaatctttctgagtggtccagtgcaagtccagggcttgattgtaacatccatccttgtgctcttgcctctaactttccccgaccatatgggcagtttttcgctatctctggcttctatgtggtttttaaattttttaatttgactgctgatgcgactctaggtgatgttcaaaaaagaggtcaggaattttgtgaaaaaccatggaaagttgcaaagagtagtgttcctccacagccttttgtagaacaatattgcttcagagctccttatatttcatcactactgagagagggattgcagattaaagatagtcaggtgataattggctctggcagtattacttggactcatggagttgctttgctggaggctggtcaagcattgtcttcacgactagatattcaaggataccgaatactgcacagggagataaatccaaatattctcatagtactgtttctgatttcaattgtgttggtcatatgtgccatactatgcgtcagcaattcgataccaagatcattccgcaagtcttatctgccaattcataggcataattctggaggcagttctgttcttggtatgggattgcctttcaaacatttattatggaatcccattagttcaggtgatggtagaacaaagacaccactgagccctactgttgctgggtcagatcctcatccatttgcaggactaggaggcagcagtgtcgagcttatggagtcctcgaggcaatccttgggtgcctatcacagctattctgttgggagcttaggtcagatgcagttttctagcggggtgaggaaccctagccgaggtcagactacacttcaaagtcggaggtcgcaatcaagagaggatctcagttcttcacttgctgatattcattttccaaaagtgtagcactgcatcaaggaatgactagaatgagatccttacatgccataacaaactctgtaaataatagctccagagttcgaactgcttgatttcttctctaatcagaagtcaattttgtctgtccgcttacacttcaatgaggtttaggattcatataaatgaacttatgacttgtgcctatcctggacatgatacatccattcatcccattgtatgtgctcaagaacataccatagcagtgaagttctggtagtgtactggaagatatatttatgccgttcaccagactggttgaccatggctacagcctacaactttatagatcgattgtgctgcaatcagggatgttatttttttgtatctgagacataataaaggtgcatgtggtctcatgtactgttgtaccctctaggctctagtggctctgtgaggttactcttctttcctggaataccttttgataggctactctgtggtatcaactgaaatcatgaaacactgacatcagttctactggattatctagttgcgtactgtgtatacacatctattgagttttttttgttggcatagtatctactttgatgacactgaaaatcagtataggaacatttgggccaatgtttttcctcgttgagctgagtttgatctgtattgcacatttgcttgtggatc

SEQ ID NO: 7391 - DNA, 1129 bp, Zea mays
atgtccttcacctactccgccatcggcttgtccctcggcatcgcgcagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcaccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcggcgcgccgccgcggcctggcccgacagcgccttcgtcgcgcgggagctccgcgtggggcccctcgccctcagcgtgttccgcctcacgtggcggtcggcgttcgtgtgcgtcaccaccgtcgtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggctgtgctggggcctggactggcctgggtttggacgtatgtgcatgcagcattcattgcggtgcgttcaactgtggtcaacaagggagggagacggatgcagatgtttgcatggaggcccctatagaacaagtgaaaggtttaggcgcccttgtgcacatgctggtcgcattccttgcaagaataccaggggtggggccagaatggcatgagctgggtgtttgttgtgatgacgagtctactgtaggtgtatgaagcagcaacaaaaaacatgttcctttc

SEQ ID NO: 7392 - DNA, 1305 bp, Zea mays
caccaagttgtcgatcacttgcctgctcttgagctcgatcaagctatcatcagctacagcttccgatcccaactgcaactgtagcagcgacaactgccatggaggcccagaacgtggaggttgctgccctggtgcagaagatcacggccctccacgccgacatcgccaagctgccgtcgctgagcccgtcccccgacgccaacgcgctgttcaccagcctcgtcatggcctgcgtcccgccaaaccctgtcgacgtgaccaagctcagcccggacgtccaggggatgcgagaggagctcatccgcctctgctccgacgccgagggccaccttgaggcgcactacgccgacatgctcgccgccttcgacaacccgctcgaccacctcggccgctttccatacttcagcaactacatcgacctgagcaagctggagtttgacctccttgtccgctacatcccagggctcgcgccttcccgtgtcgccttcgtcggctccggccccttgccgttcagctcgctcgtgctcgccgcgcgccacctgcccaacacactgttcgacaactacgatcggtgtgccgccgccaacgaccgtgctcggaagctggtccgtgcggacaaggacctgaacgcgcgcatgtccttccacacggtcgacgtcgccaacctcacggacgagctcgccaagtacgacgtggtcttccttgccgcgctagtaggcatggcggctgaggacaaggccaaggtggttgcgcatcttggcaggcacatggcggacggagcggctctcgtcgtgcgcagcgcccacggggctcgcggcttcctctacccgatcgtcgatcctgaggacattcgtcgcggtgggttcgacgtgcttgccgtgtaccacccggacaacgaggtcatcaactccgtcatcatcgcgcgtaaaatggacgcccacaccaaggggcttcagaatggacacgcgcatgcacgcggcacggtgccgatagtgagcccgccgtgcaagtgctgcaagatggaggccaacgcgctccagaagagagaggagatggcgaccacgacagagctgtccatctgatgcaaggaacttttgagcacctatgcgtgcgtggtaacaataatagttacaaatcgctgctgctgaatttctcatgcacttctttattcgatgctatgcattgtgaagtgtttaataagaatgtgttcttcctatgtgatgatatatgccaagttgctagcacttttacgtgtgatgtgacggacatcgtgtgtgaacagtttgatggatgggttggtttatc

SEQ ID NO: 7393 - DNA, 1569 bp, Zea mays
gtttcgatggcgctgctagtgcggagggcacggagggcggcgaccaaggccgcggtgtccctcgccggcagaaccggcagcgtggagcttgccatcccggcgcacttccggtgcccgatctcgctggacctcatgcgggaccccgtcacggcgccggcgggaatcacgtacgaccgcgagagcatcgaggcgtggctggacacgggccgcgccacctgccccgtcacccacgcgccgctccgccacgaggacctcgtccccaaccacgccatccgtcgcgtcatccaggactggtgcgtcgccaaccgctcccgcggcgtcgagcgcatccccacgcccaagatccccgtcacgcccgtccaggcctccgagctcctcttcgacctcgccgggtccgcgcgccgccgcgatgccgctgcgcggtgcgccgaggtggtcaccaagataaaggtcctcgccagggacagcgagcgaaacaggcgctgcttcgcgtccatcggcacgggccgcgtgctcgccgccgcgttcgagtcgctcgctgctgctgctgctgctgacgccgccgcaccggcggggcgcgtccttgaggacatcctggcggcattggtctgcatgatgccgttggacgaggaggccgccaggacgttggccttgccgacctcgctggggtctctggtcgccattgctgagaacggcagcttggcaggaaggctgaacgccgtgctggcaatcaaggaggtcgtctcatgcgacggggcggtcactgatctgagcgggaaggccgacgagatcgtagacgcgctggcaaagatcatcaagtctccaatctgtcctcaggcaaccaaggccggcatggtcgccacctatcacctggcgctatacgacgagcgtgtcgcggcgcgccttgccgctgccgggctcgtccccgtgctcgttgaggtccttgtagacgccgacaagagcatgtccgagaaggcactggccgtgctcgacgcggtgctcgcctcggaggaaggccgcgcgagcgcgcgggcgcacgcgctcgccgtgcccatgctcatcaagaagatgttccgcgtgtccgacctggctacccagcttgccgtgtcggcgatgtggcggctcggaaaggcgcacagcgacggcgaggatgacggtgcggtgacgcggtgtcttgtcgaggcgctgggggttggggcgttccagaagcttctcctgctcttgcaggtcggctgcagggacgcaaccaaggagaaggccaccgagctgctcaagttgctcaacaagtacaagagcgtaggcgaatgcgtcgacgctgtggatttcagagggctgaataagctgtcatcttaaatcaatgggggctgcgatgtaaaaaatgtgtattttgtaaaacagagagacgatttaacttgtaagtagatgcagataggctagttgcaattttgttgggcgtgcttgcatgctatttcagcagcttagtttcaaacggaaacttagatccgaattccgttttatgaagaacttcagtgtaaatttcttgttttaaaagatgtttttttttctttt

SEQ ID NO: 7394 - DNA, 827 bp, Zea mays
ccacgcgtccgcccacgcgtccgcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 7395 - DNA, 1927 bp, Zea mays
cttcaacaagctaggcagctgcaagcatctcccaaatcccagcctgctgccccgcgcgaacacacttctcttgtcgttgcattgcagggcagctagccggctacagcatccgccatggcgcgcggcggggacggcctgcaggtgctcagcgcgctggacgcggcgaagacgcagtggtaccacttcacggccatcatcgtcgccggcatgggcttcttcacggacgcctacgacctcttctgcatctccctcgtcaccaagctgctggggcgcatctactacacggacaccagcaaggacaacccgggctcgctcccgcccaacgtcgccgcggcggtcaacggcgtcgccttctgcggcacgctggccggccagctcttcttcggctggctcggggacaagctcgggcgcaagagcgtgtacgggatgacgctcatgctcatggtcatctgctccgtcgcgtcgggcctctcgttcggccacacgcccacgggggtcatggccacgctctgcttcttccgcttctggctcgggttcggcatcggcggggactacccgctgtcggcgaccatcatgtccgagtacgccaacaagaagacccgcggcgccttcatcgcggccgtcctcgccatgcagggcttcggcatcctcgccggcggcattgtcacgctcgtcatctccgccgccttccgcgcggggtacccggccccggcgtacagggacgaccacttcaactccaccgtgccgcaggccgactacgtgtggcgcatcatcctcatcctgggcgccgcgccggcgatgctcacctactactggcggatgaagatgcccgagacggcgcgctacaccgcgctcgtggccaagaacgccaagcaggccgcggccgacatgtccagggtgctccagacggagatcgtcgacgagcaggagaagctggacgagatggtcaccgccgagagcaacaccttcggcctcttctccagggagttcgcgcgccgccacgggctccacctcgtcggcacctccaccacgtggttcctgctcgacatcgccttctacagccagaacctgttccagaaggacatcttcaccagcatcaactggatccccaaggccaacaccatgagcgcgctggaggaggtgttccgcatctcccgcgcccagacgctcatcgcgctctgcggcaccgtcccgggctactggttcaccgtcgcgctcatcgacgtcgtcggccgcttcgccatccagctgctcggcttcttcatgatgaccgtcttcatgctcggcctcgccatcccctaccaccactggaccacgcccggcaaccacatcggcttcgtcgtcatgtacgccttcaccttcttcttcgcaaacttcggccccaacagcaccaccttcatcgtgccggccgagatcttcccggcgcggctgcggtccacatgccacggcatctccgccgcctcggggaaggccggcgccatcatcggggcctttgggttcctgtacgcggcgcagaaccaggacaagagcaaggcggacgccgggtaccccgcgggcatcggcgtgcgcaattcgctcttcgtcctcgctgcctccaacttgcttggctttatcctcaccttcctcgtgccggagtccaagggtaagtcgctcgaggagatgtccggggaggctgacgacgccgaggacgacgccgtcggcacccgcgcggtgcggccgtcggggacccagatggtgtagaatcgaacatggcgacgcgtgcacacgggtcctccatcctggggcccgactgggaagacaaggcgcgccggttcaagcctgccgatgctttgctgtgcagaagtagttcgtacaggtgcatgtgtgttataggcgggaaagtaagtgaacttacatgcttgtatttattatatccaaccttacgtac

SEQ ID NO: 7396 - DNA, 1851 bp, Zea mays
gacgcgagaccaagacaaaagcagccagcggaaaagaggggaaccctctcatcccatcccaccagttccccaattccatttctccatccatgacagctcgccatttccccacctgttcctacgctaccgccacctaaaaaaattccaggcactatccatttcaatcttgctcaaaggtcatttcattccggccggtgccttttttaggccgattggagggaaggctggtctgtgttttgttttcctgctgcctcttgggcgagttgaatttgggcgcctcttgctccaggcagtattttatcgagctagagtctggtacccggcgattcttgcttggtccaggcgccaaggcgaggaattgggcctagctccagctcaaatctgtgccttgttgcagacagaaggatttctgcatgggcgaccataactaagatgtgagattgggtggcgtcagctcggctggtgggtgattcttggtgcgtacacagacacatccctggaggcttgagctgatttggcgaggaggacagtgcaggagagagatgtctttcaggagcctgattcaggacatgaaggacgagttcgggagcatctcgcggcacagcctgcggtcccggtctcaccgctccgccgggaacgcggcgcgggcggcggccgcgggaccgtcggaggcgatggatcagagctgctggtcgcagctgccccccgagctcctgcgggaggtgctggtgaggatcgaggcgtcggagagctggtggccagcgcgcaaggacgtggtgtcaggcgccggcgtctgccggacctggaggggcatcatgaaggaggccgtgcgcgtcccggaggtgtcagggaagctcacgttccccatctcgcttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccatccctgcatcagctgttaaggaaggagggaaaactcctacacagactgaatttccacttagcagccttgactctttcccatcatttccattcttcagatctaaatcagctcggatagacagttcaacgtcgcaatcatccagtcagagggaagataggttggtgctgaagaacaagtctcctaggtggcacgaacaactgcagtgttggtgcctgaatttccgtgggcgggtcactgttgcctcggttaaaaacttccagttggtggcttctgaggacaatggaccagagagccaagagagtgacaaggtgattctccaattcggaaagatcggaaaagacttgttcaccatggactacggttatccaatatcggcatttcaagcttttgcaatttgtctgagcagttttgatacaaaaattgcctgcgaatgaggcaaggtgattttcccccttctctattccccttgcttgtattatggacatgcagtaaaattttattgaacatgcaatttccaatgtcaaggatgattggatg

SEQ ID NO: 7397 - DNA, 951 bp, Zea mays
ccacgcgtccgcggacgcgtgggcgactgacgagagggggagagagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctaactgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcactaggtgttgtttgtaataagattgcaaagatgtgtaaaatttgttttgtgcttccaaaaaaaaaaaaaaaaaaaaaaaaaaaaaaaaaaaaaaaaaaaaaaaaaaaaaaaaaaaaaaaaag

SEQ ID NO: 7398 - DNA, 1426 bp, Zea mays
cagagctcagcgccctgtctccctccctccctccattcctcctcctccgctctctctctctgcaggcctgcactgtgaggagactgtgacccggggacggagagctcctttcttctctctcatcgctccaccccttatttaccggtcggttgttcctgggccgtcccgtcccgtcccgtcgtctcgcctgggttctcgcttgcttctcaccatcactaccaccgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacggtcagcggctcctgctcctcagctcctcgcttgctcccctctcgtccggtcccttccgttccgtctggccactccattcctcccctctgctggtctcgacgacccttctcggcggcccgtgtactctgatccgggattatggctatgcataggaattgcatggcatgatcaagcttcatccattcgtcgtctgtcagttgcttatcagtactgttgaagaaaaaacgaaattaaatttccgcagcatgaactaattaaggcccgggtttcgttcctttcctcgtttggttcagttaccgccgtcgacagcggcaagaaggcaatggagcatctccggctgatggagcaaggcggccagctggattcatgtgccgctgatgctaatcggataaccattgacatcgtgctcacggactactgcatgccggagatgactggctacgacctgctcaaggccatcaaggcgctgagctcccctaacccgatcccggtggtggtgatgtcgtcggagaacgagccccagaggatcagcagatgcctaaccgccggtgccgaggatttcatcctcaagccactcaagaccaaggacgtgcagcgcctgcgcaactgctccagcgccgctagacccagggacgacgcggcccaccagtgcgagagcttgaggaggagcagcagaaagctgcggtcggatcaggtcgccgcgcctggccacagatcgcaaccgacgacgggattaaccatggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgcgatgcggtattattagtgtaaccactaaggctccaggctttcagttcaattcccccctgtaatccagtcctggcatgaggagccaccagttcttgctcgccgctccctatatttccatttcacttttcacc

SEQ ID NO: 7399 - DNA, 609 bp, Zea mays
tccgacgcgctccgttcccctttccctttccgaagcttctcgaccccccatcccctccctgacatggccgacaacgcgaaggccgcggcggcgcatgcgaggccggagtcgtcgcaggaggaggaggaggactggaaggaggccgagggggacgtcgccgaagtcgaccgcgccgccaccaatggcgccggcgaggggggcgtgcccacagacaggccgatccgggtctacgccgacggcatctacgacctcttccacttcggccacgccaagtcgctggagcaggccaagaagtcgtgagaacaccgcccccaccctcctcctcctcctccgcctattggacctgccgtctccggccgaattgaactgccccacgatctgccccttgcgctggcgtggggggccgggcgctgttgcgtgctagcgtgcaatggtcgctttagcagcgtttgcggtggcgtctggatcgcgctccatcaggcggttcggtgcgagattggcgctgagttgtttctccccacgtcttccctttgtggcatttttgtgatgagttgtcccacgcgtctagcagttcgggaatgtttttctatgagtaaattaccccgtgtg

SEQ ID NO: 7400 - DNA, 1269 bp, Zea mays
gtgtttcctcagtggactagtgtgaagctgtgcttagcgtagcggaagggaggaaggacaaggcaaggcaactgatggcggcgggcggcggaggcggctcggcggcgccgttcgtgtggaagacgtacacgatggtggaggaccccgggacggcaggggtgatcggctggggcagcggcaacaacagtttcgtcgtcgccgaccccttcgtcttctcgcagacgctgctccccgcgcacttcaagcacaacaacttctccagcttcgtccgccagctcaacacctatggcttccgcaaggttcatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctccggcggtgccgccgagccgcccgctgcggaggtcggcgagaagcgggccaggctgctgctcgacggtgacagcatggtggcgctcggtcccgaggccgtcgacttcgccgggttctacagcggcggcggtgcgttcggcgatgttgccgtggatgctgccgctgggtcccgcggaggcgggttctcgtttgcgttcggcgtggacgcggggtactgaatgacgagcaggcgccgccattgtcagcagcttggcccgcttatgctgctgtcgagcttcctgccaatgccattgcgctgagcggcggcagccgtcacatggaagcatggcaggggatggatgataatgatgttaagttctatccctggctccctgctacatggataggatgtgtgtctgatgctgcttttcgtggatctatatgggcggggagcgactactgcgtcgagatctaaaaataaggggatatactgtcatggagtgtgaccttcgaagttcccaatatgagtaggtttgatgttgtacatgaccagtgcagcagcactaatatttcaatctcctgcggatacgcagctggaaaattggcatcgctattatttagcccttttct

SEQ ID NO: 7401 - DNA, 1166 bp, Zea mays
gcctcttccccttccccgcgtgccgcgtcaaacaaatctaggcttccaagcgagcgaaagcctacctccgccagccgatctaccaacatcctctccgccgattggaggcacctgcgaagatgccgcagcggcactcaaagaacaacaacgacctcgccttcttcacgtacgaggagaagcggaagctcgggtacggcacgcagcgggagcgcctggggaaggactccatcaagcccttcgacgcctgctgcctctgcctcaagccgctcatcgacccgctctgctgccccaagggccataccttctgcaaggagtgcatccttgagtgcctcctcgcccagaagaaggacatcaagcgtaagctagcagctcacgaggcccagaagaagcaagagaaggaagaggaggaggaaaagctaattctgcagaaggctaaggagttggatgcctttgatcagcaaaatcatggggctgttccccagtaccatgatcgcagtggttcccaaggcaagaatgggtttcatggagcgaacagtgtgaaggtcacttcttttgaagaggaagccctccgtaacatgaaggcattctggcttccttcagctactcctgaagctacggtcaaggtagatgcaccctccaccgacactgtctgccctgaggggcaggagaagctcaagttgaaatcgctcttccctatctcatttatggaggaaactgctgatcagaagaggaagaaggcaatggaaaagagctatatgtgccctagttgcaaatccactctcacaaatacaatgtccctcgtggcggtcagcgcctgtggccacgtcttctgcaagaagtgctctgacaagtttctagtaaaggataaagtttgcttagagtgcagcaaatcattcaaggagaggaatctggttccattagagaaaggaggaactgggtttgcggcacatgatgaacgcttggaggcaagggatttcaagcatttgggcagcggttctgggttaggactagtgaagcctgcaccaaaagcttactagccttgaatacttgtagccgctgttatatatcgtttatcatggtgtcatgaaattatgtataacctggaaattttgttttgtggcatcaaaatcgctctattcaggacagttctccagtctttaaaaaaa

SEQ ID NO: 7402 - DNA, 1000 bp, Zea mays
gtcaccaggagtgggggaggggcggaccccatgacgccggggagtacaagcagatgcccgacgacacgggcttcttccggcgcgagggcacttggagcaccgagtacgggcatttcttcctggcgtggtattcaggcatgctgctggagcacggcgaccgcgtccttgccgcggccgaggccgtgttcggcggcacgggcgcaacgctctccgccaaggtcgccggcatccactggcactaccggactcggtcccatgcggcggagctcacggccgggtactacaacacgcgggaccgcgacgggtacgcgccgatcgcgcgcatgctggccaagcgcggcgccgtgctcaacttcacatgcatggagatgaaggacgagcagcagccgaaacacgccagctgctccccggagctgctggtgcagcaggtcaagaccgcggccagcgccgccggggtggagctcgccggcgagaacgcgctggagcggtacgacgaagcggcgttctcgcaggtggcgtcgacagcgcgcggcgccgccctggccgccttcacgtacctgcgcatgaacaagacgctctttgacggcgacaactggcggcagttcgtgtccttcgtcagggccatggccgacggcggcgcgagaccagcactgccacggtgcgacacggggcactcggacctgtacgtcgggttcctcgacgccgccaagaagagcaaggcgccggaggctgagggcgccgccaccgccgcggcattgtaggtggatgctcatgcctgtgcgtgcacacagacacatgcgccgtgctgttgtataacgtgcaccggagaaggggaactgtatgtatagattcagggccttgcaggttgcagagttttataggctgtaatcgagcaggtcggtaaggaggcaggcatgtcagaacttaggctgtcttcagttcatttgtcccatttggaactgtattgttataagtctaatctctgtagagagaattctat

SEQ ID NO: 7403 - DNA, 1458 bp, Zea mays
tcatcaccgcaagcgtgcgcgcaacccagctcccaccgacgactgcaccggccgtcgctgccgcgctacttcggccccttttccggcgacgagcaccaccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatctttgatct

SEQ ID NO: 7404 - DNA, 789 bp, Zea mays
ccacgcgtccgcggacgcgtgggtttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgtactaatgttcccccatgttctgtttctcgttctgattctgcaattcgtcatattgttgaatttaaaaaaaaaaaaaaaaag

SEQ ID NO: 7405 - DNA, 823 bp, Zea mays
tggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccatgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7406 - DNA, 1276 bp, Zea mays
caactcccgagggcccatttcgccgtctttcactccatcaccccctctcccccagtcccccgtccctttcccctcagccatctccttccccctcacctcgccatggcgttcttctctcaccaccatctccagcagccacacccgcagcaggcaccgcccccgaatcagcagcagccggtgcttccttccttcaggaacgcgctaccggtgcctgtggatggccagatcccagcgcccctcaccttcttcaacccgccgcctgccttcccggagcagcccgcgcagacaacgctggtggatgcggtggggctgacggcagctgctgggcttgggtggaggcagccgagggagcaggaactgcttggagaaaactcccagatgtcgtccatcgattttctgcagacgggctcggcggtatcgacggggctggcgctgtctctggaggaccggcgccacggcggcggcggggctgggaactcctccggcgattcaccgctgctcctgctgcccatgctggacgatgacatttcacgcgaggtccagcggcttgacgctgatatggaccgcttcattaaagctcagagtgaacggctgaggcaatctatactggagaaagttcaggcaaagcaatttgaggcactggcctcagttgaggacaagatattcagaaaaatacgggataaagaggcggaagtggaaaccatcaacaaaaggaactctgaactagaggaccagattaagcatttgggagtggaagttggtgcttggcagcaaagggccaagtacaatgagagcctgatcaatgcactcaagtacaacttggaacaagtatgtgctcaccagagcaaggacttcaaggaaggctgcggtgatagcgaggtagatgacacggcgtcctgtccctatggtggtgctgtcaatttgcaactgatgccaaaggagaacagacaaccgaagaatttaacggcttgcagggtctgtaaatcaagtgaggcatgcatgctcttgctgccgtgtcggcatctttgtctatgcaaggagtgcgagagcaagctgagcatctgccccctgtgccagtcctccaagatacttggcatggagatatattatgcatagaatataatttatgtatcacattagtatcgtacgagatactgctatgttaatacgtcaatctattgccgaagttcagaacctatgtaccactattgacttgccactggatcaaaaaaagactgccgtttatggtagatttaacgcagcaaatttctttgcg

SEQ ID NO: 7407 - DNA, 1340 bp, Zea mays
cgatcccgtcaccgctcacctccttctccaaacactgactccgcttcccgtccccatcccgctgcgcaagatcgggaggggacgaagagaggtcgaccgggaggagatgcaccgagaccgaggcgtctctgcggcagcgatacccggtgaccggaagcggatcggcgagcctatggacagatcgtctccatctacgtcgtgggggttctccggagggcgcgagaaggagcggatcggcgtgggcaagcagccggagatgcctcgctccggcggcggatccaccgccatgtccaagagcaagctctctgacgcagaatcagaaactgacagcgaagaatcagatgtgagtggttctgatggggaagatacttcgtggatttcatggttctgtagcttaaagggcaatgaatttttctgtgaggttgatgatgactacatacaagatgatttcaacctctgtgggctaagcaaccaagttccatattatgactatgcacttgatctgatattagatgttgaatcttcccatggtgatatgttgacagaagagcaaaatgaacttattgaatcagctgctgagatgctctatggattgattcatgttcggtatattattacaagtaaagggctgtccgcaatgctggataagtacaggaacgttgagttcggcagatgccctcgagtgaattgcagcggccaaccatgccttcctgttgggcaatcggatgttcctcgttcaagtacggtgaagatttactgccctagatgtgaagacatctacactccaagatccaaatatctaagcaacatcgacgggacttactttgggacaacattcccccacttgttcctgatgacatacccgcatttgaagccccagaagccgctgcagcaatacgttcccagggtatttgggttcaaaatccgtaagccatgacaaatttgaaggttgaatgtataaaaggttcaaatagcgccctgttatctgctggccccgcagtgttcacacgacacgtcatcggaatacacctgacccgcggctgacctccctagtctggtttcttgctctggcctgaaattctgattgatgcttgtggtttgtttagcctagtgaatcaatccatatttttttacgatcatacgtattatggctttaatggtttaacaaccatctatatttttgttggcacggttcatattcgttttttactctgattgtttactcgttcgcttactgcttctacactatggattgcatctgtaacaatccaagaacaaatcagttattgtgtgccgcatttacttagattgtcaaaataggagtatgatgatggcatctt

SEQ ID NO: 7408 - DNA, 1328 bp, Zea mays
ttgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtg

SEQ ID NO: 7409 - DNA, 1088 bp, Zea mays
cgaagcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaagcccatcccgacgcacgccgtcgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcgccacaccatcgtctccgctctggatgaatggattcaaacccgtcgtcgtttgcttttgctcctcgcgccacgttcaattaatgcttgtgtatgcatgtatgtgccagtatgatgtgccgttgccctggtccattcatttccctttcttttttcggggtgaaatagatgtaaagatctcgtcttgcctgccgtactcgcgctgtgttgggaaaaattggttttcgttccaagtttgttt

SEQ ID NO: 7410 - DNA, 1286 bp, Zea mays
cgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgttt

SEQ ID NO: 7411 - DNA, 1149 bp, Zea mays
tgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggcccgagttgaac

SEQ ID NO: 7412 - DNA, 1078 bp, Zea mays
agggttctagcgcctatctggtttctccctgcgccgccgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagtcgggaacccggaagggcgagaaccccgagaaggcctccatcgaggtcgtgtggaagcccaagaccggccagatcggaaggcaagagagggaatatgagatgacactcaagaggacgttgcagagcatctgcttgctcacagttcatcctaacaccaccacctctgtcgtgcttcaggttgtgggtgatgatggttctcttatgtcatgtgcaattaatgcttcttgtgctgctcttgcatttgctggaatccctatgaaacatctcgctgtcgcgattagctgtggagtgatggacaatggtgtggttatcttagacactagcagagcagaagagcagcaagctaggtcgtttgctcacctggtgtttccgaactcgcgcaagtcagtcgaatcgaaggacacgacacagcgagatgaggagtccgagcgaggattgataacttgcatcacgcatggagcaatgtccgaggatgactatttcaactgcatagagaggggtgtcatggcgtcctcgaggatctcggatttcatgaggaagacactgcagaaggaggcttccagggatgcctgacctgagtagcaaatgtattagcacgactgagaagctgcctgcctgtgataggcgatggcgatggcaatggtgtgtagacagcagctgggtctctagttttgacggcatgtagtcgtgttagaatgaaggaggcaagggtgcgatggagtggaggtcaatcggcgtgtgatgccacgtcactagcttagctgcggatggtttggtggacttttgaggaacagataatgagattgtatgcacggcacgctgaaattttacttgaacgccgcccgattaaaac

SEQ ID NO: 7413 - DNA, 1396 bp, Zea mays
ctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaggaaacgttccttgcttgcaccctcggctggtgcattgaatggcttcaggctttctttcttgtgcttgatgatatcatggatgactctcacactcgtcgcggccagccttgctggttcagggtgcctcaggttggcttaattgctgcgaatgacgggatcatccttcgcaaccatatctcacggatccttcggcgccactttaagggcaaaccttactatgctgatctccttgatttgttcaatgaggttgagttcaagacagcttcaggtcagctgctggaccttatcactacccatgagggagaaaaagatctaacaaagtataacataacagttcacggtcgaattgttcaatacaagacagcctattattcattttatctgccggttgcatgtgccctgctgctctctggcgagaatttggacaattatggtgatgtagagaacatccttgttgaaatgggaacatactttcaagtccaggatgactatctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaatccttcttgcacaagatctacaagaggcagaagtagggtgctcttggataaacgagctcaggagtcgttactccttcgcatgcttgacataaccggacttcctcacctggttgctctagtatgatgtggagcgtctagttaaaaaaaatcgatgtagtatgaagcaccttgctgctctgaatattaacaggcaattaaggcaaggtgctgtttcggtttggtggaccgcatgttgcagataataaattagttgttttgtc

SEQ ID NO: 7414 - DNA, 1149 bp, Zea mays
tggcgtccgcccaaccctccaaaccaaggcggccaagccccttccatttgccaggcggccacaccatctgatccccaattcgtttccacctatcgagccaaggtgcgacgacggcggtcgcagcgtcccctccctccctccgtaccgctgccgccggtctaccaaacggtgaaatatttacgtaagcgaatcagggtcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaattatttcctcctctggatggttgaggggatgaatggtgagcgggccagatcacgcccagctactcacagcgagcaacatactccatggctctcaagcagcagcagagcaaatggaaatgcaggctgttcaaatcccacaagacgccaccttccgctgccaccgccggttgacactacttcgcccaccaatgcaaatcatgccaaccatggggtccctgtccctctgctgaacgcagagagagtacaagcttcgctgcgcaagtccttgtcgttcctggttcacctgaccgccaagtttcccctggtgttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatactgttgttgagtccttgtataactgaaccttccctagatcttgttgcaagcgtggatgctattgcaaagttttggtttttacacc

SEQ ID NO: 7415 - DNA, 1079 bp, Zea mays
accttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctgaggcttttcttgtagtttaggtctagtatgaactgcccttcgaatttaaaggacctggaaagccattcttttcattcttgagttcctttttaggaaacggagcttttaaaatttgtatagaatgcatattttgacattaaaattattatttgattgtattctacacacagcagttccagctgaagttttactagtgcagatctc

SEQ ID NO: 7416 - DNA, 2309 bp, Zea mays
cgttcatccatcacagtatcacaccatccccactctcttctctccacccggcgagcggacactcccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtagaggaaggaaggactcgagatggacaccgtcagcgtccccgtggtggccgttgcgaatgggatcggggaggtggagcgcaaggtgcagaagagctactgggaggagcactccaagtgcctcactgtcgagtccatgatgctcgactcccgtgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaaccaaagcataaatgggcatcacaagaacataaccttcaggtgtgccgatgtgacatctaacgacttgaagattgaagataactctgttgatctgatattttcaaactggctattaatgtatctttcagatgaggaggtccaaaagcttgtggggaaaatggtaaaatggttaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgcattggggcttatgtcaaaaacaagaagaatcaaaaccagatatgctggttatgggaaaaggtaaaatcaacagaagacagagattttcaaagattcctggacaacgtgcaatacaaaacaagtgggatattacgttacgagcgtgtctttggtgaaggttttgtgagcactggtggaatcgagacaacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaatttgaagttgctgattgcaccacaaaggattacccagaaaatagttttgacgtcatctacagccgtgacaccatccttcacatacaagacaagcctgctctgttcagaagcttcttcaaatggctaaagcccggtggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagctaggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctctaactctgcttctagaccggtgatggttcagcttagaagcaggggatcttcatcatcagaataaaaacgtgtgttgttgtgttgctgtgtctacgccactagtatttctgttgttacttatgttctaggtaaactgcgcagccagagcagagctgaagaatatgtactgcttgctcgctcttgtgtggttgtgtctacccctactagcatttcagctttgttgtaggtaaactgcgaacccagagttgcagaacccgtactgctcgtttaagttcatggtgaactacgagctaaaaggctgttgccagagtggatgtcacttgtcactggaggtccccggttcaattcagatgttgctttggc

SEQ ID NO: 7417 - DNA, 851 bp, Zea mays
gagagagaggcgaggaaggagggagagagcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgagctcctcgagttggcggggaacgcagcgcgggacaacaagaagaaccggatcatcccgcggcacgtactgctggcgatccgcaacgacgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcattaggtgctgtttgtaataagattgcaaagatgtgtaaaatttgttttgtgcttccattcaaa

SEQ ID NO: 7418 - DNA, 1925 bp, Zea mays
gctggctgaccagaacacttgagcagactagcaaggccttcagaccgggagggctccctgtcctgtcccccgcgccgccgcggatggccggagccaccacgccggcatcaggcgccctcgtcaggctctgcctgccttcgctcctcctctttctgtaccggtgctgcagatgtgaggctgttgagatggagagaacccttgcgatgatcaagcccgatggtttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagacctgacgccgttgcgcaatggcgcactttgattggaccaactgatgcaaaaaaggccaaaacctctcatccaaacagcattagagcaatgtgtgggctggactctgagaaaaattgcgtgcatggttcggattcaccagaatctgcagacagagagatctcatttttcttcggagaagctgaatccgtaactgtggaacatgatgagctatagacgccacactggtatcaggcaagtcagcaaactgaattttgatgtgtctttgaactcttaggctatctcctgtagcttcttactcgtacccgtttcttattattttaaaagttattatgtaaacagtataatttatagtgcaaaacagtgtcttgcatggccatatgcttgtggcttcatatgcagagtttactgatctgctgtgcacattgtgattgctaagactaggatggctgagcagctgaggcctattggccattcatatgcttctgcttgctcaagtgtttactctcgaagtaattatgggcatgtttggttcggattattattctcttttccacggagaaacaccagaatcgacggatagtccgccaaatgtcatgctttttccgcttttcctcaccgcggcttcggtagcaagcgtggggttgaacaaaaaggccagaatcgtaagacgccaatagaatcatgattctccccaccgtcgattgtttcggacgcgctcccgtgaaaagcgagtacaaacatgccctatgtgtaaagaaacttatatactactcccttcattcttttttatttgtcgcggattcgaaaacagaggtagtatttgattgcactggcactgcacacaaatagatctttgcaactgtcacttggcagtccttcaaataatgcaaattaggatacagtagaatagaatccatgaaacgggaagagaagtgctggtttgtccaagagccggatgcttaggatcaggaatttattttcaaataatgcaaattatgctggcagattggtttcttttttttatttttattttcgcaaggatatagatttgcttgtggtctgtttattcatcatgtagtttcgtttgctttggtgagtagtggcaatattggccggctcattggacaacgtgggagagtatcgactctgctgcttctagtgttcgtcatgcttcttttatgaactaaacccgaagacgctgcaatttgaggaggggatgtcagttgtcacagaggagagagtcatttttagggctagtttggaaatctcatttttttcaagagatttttattttcctaaaggaaattagtttatttttctttgagaaaatagaattcccttgggaaattagagtttctaaacgagcccttaatttcgtaaaattatgtccggagtccatatttcctatcggagcaccatggtccttgaacttgcaaaactatatggtgcaaaccaaatattgttttttcatccgtgttgacgtcttgtgtggcatactttaaaaaaaaa

SEQ ID NO: 7419 - DNA, 1108 bp, Zea mays
ccacgcgtccgcggacgcgtgggttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacaggtaatctatcgtactgtcatttgttagtaaaacaatactgcagctattttccgtctcactaaacatggcagaaaatttcgatcattacattattccactaataattttctctctgtacgcactcagtaccacaatggggaaacctaataaagggctaatacagcagcaatttatggtaatattattgctccctgaattttgttaactaaagattctgtatcatgctatatgtatgtttccttttttcttcttctttgttttgacaattgcttctttctctacggtgtttatccatcagctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaaaaaaaaaaaaaaaaaaaaaaag

SEQ ID NO: 7420 - DNA, 1371 bp, Zea mays
tgtaaagagtgcgaagaagcagtagcaaaaggattccattctcgtgttcttggagtggtccatcgatcgagctccgtgagagagatagcaagcaatggcgacagcagggaaggtgatcaagtgcagagccgccgtggcgtgggaggccggcaagccgctgtccatcgaggaggtggaggtggcgccgccgcaggccatggaggtgcgtatcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagtgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgccc

SEQ ID NO: 7421 - DNA, 828 bp, Zea mays
ccacgcgtccgctggctgaccagaacacttgagcagactagcaaggccttcagaccgggagggctccctgtcctgtcccccgcgccgccgcggatggccggagccaccacgccggcatcaggcgccctcgtcaggctctgcctgccttcgctcctcctctttctgtaccgatgtgaggctgttgagatggagagaacccttgcgatgatcaagcccgatggtttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagacctgacgccgttgcgcaatggcgcactttgattggaccaactgatgcaaaaaaggccaaaacctctcatccaaacagcattagagcaatgtgtgggctggactctgagaaaaattgcgtgcatggttcggattcaccagaatctgcagacagagagatctcatttttcttcggagaagctgaatccgtaactgtggaacatgatgagctatagacgccacactggtatcaggcaagtcagcaaactgaattttgatgtgtctttgaactcttaggctatctcctgtagcttcttactcgtacccgtttcttattattttaaaagttattatgtaaacagtataatttatagtgcaaaacagtgtcttgcatggccatatgcttgtggcttcaaaaaaaaaaaaaaaaaaag

SEQ ID NO: 7422 - DNA, 1616 bp, Zea mays
cagatccgtctcccggcgtcagacgcgcatctccagcaatggcggacgagaagcttgccaagctgcgcgaagccaccgccggcctcacgcagatcagcgagaacgagaagtccggcttcctcagcctcgtcggccgctacctcagcggcgacgaggagcacatcgagtgggccaagatccacacgcccaccgacgaggtggtggtgccgtacgacaccctggagtccccgccagaaggcactgaggcgaccaagaagctgctcgacaagctcgccgtgctcaagctcaacggcggcctggggaccaccatgggatgcaccggacccaaatcggtcatcgaagtgcgcaacggatttactttcctcgacctgattgtcatccagatcgagtcactcaacaagaagtacggcagcaatgtgccgctgcttctgatgaactccttcaacacccatgacgacaccttgaaaattgttgagaaatacacgaattcgagcattgaaatccacacattcaaccagagccagtaccctcgtgtggtagctgacgagttcttgccatggccgtccaagggaaagactgataaggatggctggtaccctcctggccatggtgatatcttcccatcattgatgaacagtggaaagctcgatttactactctcacagggaaaagagtatgtgttcattgcaaactcggataacttgggtgctattgttgacatgaagatactgaaccatttgatccacaagcagaatgaatattgcatggaggtcaccccaaaaactttggctgatgtaaaaggtggcacactgatctcctacgaaggaagggttcagcttctggagattgcacaagtgcctgatgcacatgtgaatgagttcaaatcaattgagaaattcaagatattcaacaccaacaatctgtgggtgaacttgaaggccatcaaacgccttgttgaagctgatgcactcaagatggagatcattccgaatcctaaggaagtcgatggtgtgaaagttcttcagctggaaacagcagctggtgcagcaattaggttctttgaccatgccattggtatcaacgttccaaggtcccgcttcctaccagttaaggcgacatcagatttgcagctagtacagtctgatctatataccttggttgatggcttcgttacacgtaattcagccagaacaaatccatcaaatccatcaattgaacttggtcctgagttcaagaaggttgggagcttccttggtcgcttcaagtcgatacctagcattgttgagcttgacagcttgaaggtttccggtgatgtttggttcggttctggaattgtactgaaggggaaagtgaccatcactgcaaaacctggcgtcaagctagaaatcccagacggagcagtgattgggaataaggatatcagtggccctgaggacctttagataagaatcagcgaatcagcaaggaggctcacttcgccaagtggcggatcatttttcgtgtttttttcctgtatattcaaacaggttccatgatattatggagaatattaattgccagtataatccagaaattttacatgtattttactttgagggaaatgttttacacactcc

SEQ ID NO: 7423 - DNA, 874 bp, Zea mays
ccacgcgtccgagccaacataaaacaagcccgcccgtcattttcgtcacccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgctccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaatgtaccgtggttgtgaaccggtcaatgtgatctgaaataaaacattgcgtgccaaaaaaaaaaaaaaaaag

SEQ ID NO: 7424 - DNA, 1100 bp, Zea mays
aggctaggctgggcatggagggaaccgctgcggcccggaagaggtcccggccggagacggcgaacggggctgccgccgccgggaagcgctccaaagacacggagtcatttcaaactggtctatcaagcaaatcgaagccttgcaccaagtttttcagtacgattgggtgcccgtttggcgagggatgtcattttctgcactttgtccctggtggttacccggcagttgcaaaaatgctgaatctaagtagctctgctgtatctgcgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggaggaggccgaggcggtggtccagggggcaagagcagcaactacaagacgaagctgtgcgagaacttcttgaagggtgcctgtacttttggtgaccggtgccacttcgcccatggcgagacggagcagcggagaggtgctgcatgagagtcgaggtgctctaggcaatgagatgccatgtgctccctccttttgctactgtgaattttcgccttgcagcgctaggcggttggactgttgtgttgtgttgcgacgtcaatggattaaactctagatttcagctttctttttttaacatataagttcgag

SEQ ID NO: 7425 - DNA, 990 bp, Zea mays
gatcgacgggcagacggtagttctgtttggcttgctcaacgggacctcgattggccttctgaaccttagtttagggttcaactccatcggattctaccagatgacgaagttggccataatacccttcacggtgctgttggagactatattcctgaagaaaagattcagtgagacgatcaagttttctctgctggtcttgctgctcggagttggcatcgcctcagttacggacctcaagttaaactgcctcgggtccgttctttccggcctcgccatcgccaccacttgtgtcggccaaattctcacgaatacgatacagaggaagctgaaggtctcgtcaacgcagctcctgtaccagtcagcgccttaccaagcagccattctgttcgccactggccccttcgtggaccatctcctcaccggccgcagcgtcttcgcccatagatacactttcccggttgtgggcttcatcgtcttgtcgtgcttgatcgcggtgtcggtgaacttcagcacgttcctggtgatcgggacgacgtcgccggtgacgtaccaggtgctgggccacctcaagacgtgcctggtgctgtcgttcgggtacacgctgctgcacgatcctttcaccgtgcggaacatcctgggcatcctcgtcgccatcttcgggatggcgctctactccatcttctcggtgcgtgagggcaagaagaagtccgcaggcgacgccctcccggtgtcacagatgcctgacaaggagacggagccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaattt

SEQ ID NO: 7426 - DNA, 720 bp, Zea mays
gacaggcagggtgcatgctgctaggaggttatttgagtacttacaggccaatggcttgaacttccctgtaattcatcacataaatttccctgaaaccattgacagagatggtcttgtcattggtgctggggccaacgttggtgctctcttagtcgatggtcttggtgatggtgtattccttgaagctgctgaccaggaatttgagttcctgagggacacatctttcaacttgctccaaggttgcaggatgcgcaacacaaaaactgaatatgtgtcttgtccttcctgcggccgaacactctttgaccttcaggaaatcagcgctgagattagagaaaagacctctcatctgccaggtgtttcgatcgctatcatgggttgtattgtcaatggaccaggagagatggctgatgccgatttcggatacgttggaggcgctcccggaaagatcgacctttatgttggcaagaccgttgtgcagcgcgccatcgccatggaaggtgcaactgacgccttgatccagctgatcaaggaccatggccgatgggtggatcctcctgccgaggagtagggctgtaggctgtagccaagtctgtagtttatatattctgtaaagcgaaacacgcaatgcaggaactgagcatacaatgtacatcatccctacacattttgtacatttattgagatctgagaaataaattagaaaccttcggtgatggc

SEQ ID NO: 7427 - DNA, 1409 bp, Zea mays
cggcgcaccgctgaagcctaaactcgcagccagccatgtcgatgagaatcgagcgtgatctccacatggccacagggaacggagaaactagctacacaaaaaattctaggattcaagagaaagctatgtttcagatgaagtcggtacttgaggaggccactagagcagtatgcacagctctcctcccacaaaccatggttgtggccgacttaggctgctcatcagggcctaacacactgcgcttcgtcactgaggtgactagaatcatagctcaccattgcaagctggagcacaaccgacgacatgaccacccgttgcagcttcagttctttctgaatgacctgcccggtaacgacttcaacaatctcttccagctcatcgagcagttcaataagtcatcgacgacacacaagggagatgcagcaactgaggcactacagcctccttgctatatctccggattgccgggctcctactacactaggatcttccctagcgaaagcgttcatcttttccactctctgttctgccttcagtggcgctctcaggcaccagagcaactgaagggcacccaaaaatcatgcctagatatctacatcacaaagactatgtcaccatcgatggtgaagttgtttcaacagcagtttcagaaggacttctccctcttcctcaggctacgctatgaggaactcgtgtctggtggccaaatggttctaacatttattggaaggaagcatgaggatgtgttcactggagagtccaaccatctttacggattgcttgcgcagtcactgaaatccctagttgatgagggtcttgtggagaaagaaaaacttgagtcattctatcttccgatctactcaccgtcggttggtgaagtggaggcgatagtgaagcaacttgggttgttcaacatgaatcatgttaaagtatttgagataaattgggacccctacgatgactcagaaggtgatgatgtgcataacaatattgagagcggtgaaaatgttgctaagtgcctacgcgcagttatggagccgctggtcgcaagccaatttggagaacgcatactcgacaagttattcaaagagtacgctcgccgtgttgccaaacaccttgagaatgagaaaacaaagcatgctgttcttgtcctatccatcaagaaagcaataattcatgtgtgaagtgtcttgtttctcactatatatctttccattagtatcacatggtaatgtatgtttgttttgaatgtgcatgtttgtgtcactagctggtgtattgaatgtcatggtgtttttgttgttttctttatcgcttctcctatattttagatgcctgaattttaaggtgatttcaggcaacactcttgtacaaggaattaataccaataaattgctccttttatgatc

SEQ ID NO: 7428 - DNA, 1319 bp, Zea mays
gtggtggagcaagcccagtccccaatcccaccctgccacccaaccttgcttcttctccgatagctatttctctgctttctctccaatcttcccgggtttccctgattaaagatggctgaatcctttgttctcagtaccggctcgaggatcccatcggttgggcttggcgtatggcaaatacaacctgacgctgccaacgacgccatctacgctgctgtcaaggctgggtatcggcatattgactgtgcagcagcatacaacaatgaggaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttggacttgtacctcatccatggtccaatccgcatcaaaaaaggaactagcacgatgacccctgaaaactttctccctacagatatccctgctacatgggcagcgatggagaagttatacgactctggcaaagctcgtgcaatcggcgtgagtaacttctcttgtaagaagctgcatgatttgcttgccgttgcacgagtgcctccagcagtcaaccaggttgagtgtcatccggtttggcagcaagacaagctccggaagctatgccaatccaatggtgttcatctttctgcattctcgcctttaggctcacctggatctccttggatcaatgggccaagtgtcctcaagaaccccattgtggtctctgttgcagacaagttgcagaaaacgcctgcccaggtcgctctacgctggggaatccaaatgggccatagtgtactcccgaaaagcgccaatgagtccaggattaaggagaacattgacatatttggctggtctattcctgaagatttgatggccaagttctctgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgctgaacacaagtattgtgtgactaatctgtgttttgatgtggtaaatgtaattgggttagtcacaataagagataagtgtctttgccacaagacttttggttcattggttgaagcatgatgtaaaccgtaaaggatattcatgaaaactaaggacgct

SEQ ID NO: 7429 - DNA, 889 bp, Zea mays
ctcgcgatcggaggagcagccatggccggccacgtcctcggcggcgtgaaggagaacccagccgcggccaacagcgccgagtccgacgggctcggccgcttcgccgtcgacgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacgccaccgccttcaccaacgccgacctcggcgccaagcaaggtggacatgagcctggttggcgtgaggttccagtagaggatcctgtggtcaaagatgctgcacaccatgctgtgaaatcgatccaagagaggtccaactccctgtttccctacgaacttctcgagatccttcgtgcccatgcacaggttgtggaagactttgcaaaatttgacattctgatgaaactgaagagaggcagcaaggaggagaagatcaaagcagaggtccataagagcctggaaggggcctttgtgctaaaccagcatcagccggcggagcatgatgagtcgagcagccagtgaactgacgtaactgtgtgagctgtagtagtaacgtacttcgtgttacgtagaagaataaggagaaaacgaccaatccggttttatctggatgtcatgtatggtcgacggtcgttgctggcttggcttccgaagacggtacctgctgtcgcacttgccgttataataggcattggaacttgtcgatttcgggagctgatctgtttgtgccgtattgtttatttataatatgatggatcgt

SEQ ID NO: 7430 - DNA, 1115 bp, Zea mays
ctgagaaggaaaagcagcggcttctcgcgcggcgcttcgatctaccggggagtcaccaggcatcaccagcacgggcggtggcaggcgcgcatcggccgcgtctcgggcaacaaggacctctacctgggaacgttcagcacgcaggaggaggccgcggaggcgtacgacgtggccgcgatcaagttccgcggcctcagcgcggtcaccaacttcgacatcacgcggtacgacgtggacaagatcatggagagcagcacgctgctcccgggcgagcaggtccggcgcaggaaggaaggcgccgacgccgcggtctcggaggccgccgccgcgctggtgcaggccggcaactgcatgacggacacctggaagatccaggcggctctgccagctgccgcgcgggccgacgagcgcggcgccggccagcagcagcgccaggacttgctgtcgagcgaggccttctcgctgctccacgacatcgtgtccgtcgacgctgctgctggtacagggacagggacagggggcatgtcgaacgcgtcgtcgtcgctggcccccagcgtgagcaactcccgggagcagagcccggaccggggcggcgccagcctcgccatgctcttcgccaagcccgtcgcggcgcccaagctggcttgcccgctgccgctggggtcgtgggtgtcgccgtccgcggtgtccgccaggccgcccggcgtgtcaatcgcgcacctgccggtgttcgccgcgtggaccgacgcatgaacaaacatccgtgtcattaccagggtatggttcttttggtttgcttagagcgtgctttttagctgggtaaggttagctgcgtaccggtgatctgatcagcatatgtgagaggaactagccatgcgtgtctgctttgtcctcctgcgattcctcctccagttgcgttgcgaggaggtttctttttgtaataccggggctagatagcacagcatggatctcctcctgtagccaacactaatttggagtaggatggttagtgttgatctcctaacttcaattaggaaaaatatgccaagtaagataagtttaaacctgtgcgctttgcaattcatcaatgagctgggattcagacctcaaaaaaa

SEQ ID NO: 7431 - DNA, 977 bp, Zea mays
aagtcgcgtgctgtgctctgctctcgcctcgcacggactcgtggtaaaggatggagaccatgtcggctctcgcgaggacggcgccgccccttgctgggaccattcgccggccgtcctgcgcgctgcggccgacggcgtccctctccttcgccgccgcttcaacgacgccccgcggccggctcgggctggggctgagcacggcgccggcggggagcgggagggcggccagggctcgcgccgtcccgcagcgcatcgtcgcctcctcggaggttgagcgaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggccctgttgtctgcatggcctgggagggtgctggtgttgttgcatcagctcgcaaattaataggagctactaacccccttcaagctgaaccagggactataaggggtgatcttgcagttcaaactggaaggaacgttgtccatggaagtgatagtcctgataatggcaagcgtgaaattgaactgtggttcaaagaaggcgagctctgccaaaatgggaatcagttcaagcaccgtggcttatagaataactcttgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagctaatttcttgtcatatttacatgtaataaagtccctctactacagtaataaattagtaaaaaa

SEQ ID NO: 7432 - DNA, 960 bp, Zea mays
gacactggcggcgggtgcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatattctgttctataggagctcctgggggcagaaatggggttattcagtggtctctctgttatcactagtaagcgtatttctggcagggttggagctaataactgcatctcaattcggcttgtcgtgccctagacggtattgctgtccaattgcattctctttgcgattgttagaactctgtatagaagcgcagcggctgccgcctgtgctctggagccggagtattgtgtgccattagaaactgtacaaaagattaatagaccgctcatttttctc

SEQ ID NO: 7433 - DNA, 1987 bp, Zea mays
ctgacagatatgacagagggcctatgcctatcgaagcatctcacaaactgcgtccactcaaacttgtctttcagccgattcctacaattccgggatccacatgcccaaaggcgacaccccctcgttgatcccatggtcgtttcagagattcggcgatgtctcagcgaggggatcgaattccaaggcgagctgctgaatttccggaaggacggtgctccacttcacaacagattaaggctcgttcctatgcacggcgatgatggctatgtgacgcatgttatcggaatccagctattctctgaggcgaacatcgatctcagcagcgtatcttatccggtgtacaagcaaaagtccagcagcaggcccagcattcaagatctgaactcatctccccacgagcacgctccgaaaatccagagcgcagaccactgcggcatgcttcagttgtcagacgaagttctcgcacacaacatcctatcccgcctgtccccaagagacgttgcgtccatcggatcggtgtgcaccagaatgcatgagctgaccaagaacgatcacctgaggaagatggtctgccagaacgcgtggggaagggacgtcaccgtgaggctggagatgagcaccaagatggtaggatggggccgtcttgcgagagagctaacaactctcgaggccgcctcatggcggaagttcacggtcggagggcgtgtcgagccttcccggtgcaacttcagtgcctgcgctgttggcaaccggcttgtcctgttcggaggggaaggcgtgaacatgcagcctatggacgacacgttcgtgctcaacctggaggccgcaacgccggagtggcggcgcgtcaaggtttctgcctccccgcccggccggtgggggcacactctgtcgtggctgaacgggtcgtggctggtagtgttcggaggctgcgggcagcaaggtctgctcaacgacgtcttcgtcctcgacctcgacgcccagcagccgacgtggagggaggtcgcgagcgagggccctccgctgccgcggtcctggcacagctcatgtaccctggacggctcgaagctcgtggtctcaggtggctgcgccgagtctggtgtcctcctcagcgacaccttcctcctcgacctcaccaaggagaagcctgcgtggagggagatccctacgtcctggtcgcccccgtcccgcctcggccacaccacgtccgtctacggcgcgaccaagctgttcatgttcggtgggctggcgaagagcggctcgctccggctgcgctccagcgacgcctacacggtggacgtcagcgaggacagcccgcagtggaggcagttggccacgacgaccgggttcccaaacgtcagtccgccgccgaggctcgaccacgtcgcggtgagcctgccctgtggacggatcatcatattcgggggctccatcgcggggctccactcccccgcgcagctgttcctgatcgatcccgcggaggagaagccgatctggaggatcctgaacgtgcctgggcagccccccaagttcgcatgggggcacagcacctgcgtggtcggcggtaccagggtcctggttctcggaggccacactggcgaggaatggatactgaacgagctgcatgagctctgcctggcaagcaggcccgacgaggacggctgatgacttcttttcgttgcacttgcacacatatggttcgttcgtctctctctgttttacgtcctatatatgcgcgctatgtcttgtttgtgtatcatctactttcagtctgttgctgcgtcgtgtcggtccgtcggtatgagaaaaaaaaaagcggaaattgattttttaaaaattagtctggatgagtttagtctattttattgtcattggagaagttctctttcatcggtctaggataagattctatggtctatatgtatgtatattttcatgtctcagaaaacacaaaaaaattattgaaggtccaatgtcttgtactcgt

SEQ ID NO: 7434 - DNA, 681 bp, Zea mays
gagaaattgtacacatattccctgcctctcgctagcgccttccctccgcaaacggaaggctctcgtgaccaccgggatgtccgccatggagaccgacatcaacgcgccgccgccgcccgccccagctggcgagggatcctctgcggccggttcgtcctcctcccgcaagcccaacaagcgcttcgagatcaagaagtggaacgccgtcgcgctctgggcatgggatatcgtcgtcgacaactgcgctatctgccgcaaccacatcatggatctatgcatcgagtgccaggcgaaccaagccagcgcgaccagcgaggagtgcactgttgcttggggagtctgtaatcatgcttttcacttccactgcatcagcaggtggcttaagactcgtcaagtgtgcccattagataacagtgagtgggagttccagaaatatggccactagttcctgggcaccctcatgtgatgttggggcttacttctagtgactgctaccactcgagtgtatttttttctgccaaacagctccatcttttactgctttggatgcttgcatgtatcacaggtcaattatcactagtagtacgtccacctgggactgtatttggattgttcgttgagaggatagtagttccattttataaatgttatgtggattttcataagtgagcttgaattgtg

SEQ ID NO: 7435 - DNA, 727 bp, Zea mays
ccacgcgtccgcactcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaaaaaaaaaaaaaaaaaag

SEQ ID NO: 7436 - DNA, 1637 bp, Zea mays
cttctctctaatgatagcatagggagagaaggcatactccgaggcatccttctcctttccctctccttccccaaacccttttcccctttccctcgccccaagaacttcatctcatctccaggcgccccttttgcgcttgcgcaggaggagctcacggggacagtgggcggagagctcgatcgctgcaccactacttcactggaggtccgcccactcccatggaggagatcacccaacactttggagttggcgcaagcagccacggccatggccacggccagcaccaccatcatcaccaccaccaccacccgtgggcatcctccctcagcgccgtcgtagcgccgctgccgccgcaaccgccaagcgcaggcctgccgctgaccctgaacacggtggcggccactgggaacagcggcggtagcggcaacccggtgctgcagcttgccaacggtggcggcctcctcgacgcatgcgtcaaggcgaaggagccctcgtcgtcgtctccctacgcaggcgacgtcgaggccatcaaggccaagatcatctcgcacccacactactactcgctcctcactgcctacctcgagtgcaacaaggtgggggcaccaccggaggtgtcggcgaggctgacggagatagcgcaggaggtggaggcgcggcagcgcacggcgctcggcggcctggccgctgcgacggagccggagctggaccagttcatggaggcgtaccacgagatgctggtgaagttcagggaggagctgacgaggccgctgcaggaggcgatggagttcatgcgaagggtggagtcgcagctgaactcgctttccatctccggaaggtcgctgcgcaacatcctttcatctggctcttctgaggaggatcaagaaggtagcggaggagagaccgagctccctgaagttgatgcacatggtgtggaccaagagctgaagcaccatctcctgaagaaatacagtggctatctaagctcgctcaagcaagaactgtcaaagaagaagaagaaagggaagctccccaaggaggctcgccagcagctccttagctggtgggatcagcactacaaatggccttacccctcagagactcagaaggtggcactggctgagtctaccgggcttgacctgaagcagatcaacaactggttcatcaaccagcggaagcggcactggaagccatccgaggagatgcaccacctgatgatggacgggtaccacaccaccaatgccttctacatggacggccacttcatcaacgacggcgggctgtaccggctcggctagccaccggtatctcgcttccatttcacaccccacggcctagctataaagactaatggttccaggtgtctgaagtactgaagacaggggggctagctatctaatgtttgtgccgcacgcatgagctgtaaggaggccatgcttaattattctgttgccgttgctactctatctatatgcgcctatgcctccgtgcatgaactatgctttaggtggttgctgctccacactgtggtggtgtgcttttgcttttgtgtggtcgtattgtatgcgtaacctgacagatggatccctgattgctacatgtttgaataatttgcatgatctagctagtttctgcct

SEQ ID NO: 7437 - DNA, 1657 bp, Zea mays
aatttagagtatacctagcaaacttggttaattgatcgatgttggttgctctgatgtttgcagcatcccgttgccgccatgggtgctggaggagatgagcagcaacccgaacatcgtatacacggacaggtccggacgccggaatcccgagtacatctccctcggctgcgacacacttccagtgctcaggggccggacccccatccaggtctacaccgactacatgcgcagcttccgccagaggttccgtgactacctcggcaatgtcatcgcggtaattaaccagccaccgttactacgatcacttaacgttgcaatagcagttgaccataaaaatgccatgcatgatgttgtgatcttaggctaaaccactcgtgtctcactgttgcaggagatccaagtgggtatgggtccttgtggagagctgaggtatccttcgtaccctgaggccaacggaacatggcgtttcccgggcatcggggagttccagtgctatgacaaggtaggcgcacttgattggaaaggtattcggagttgccggtgaaagtttgctgagttgttgtgcgttggtacagtacatgcgggcatcgctggaagccgcggcggtggcgtcgggccacgaggagtgggggaggggcggaccgcacgacgccggcgagtacaagcagatgcccgacgacacgggcttcttccggcgcgagggcacgtggagcaccgagtatgggcatttcttcctggagtggtactcgggcatgctcctggagcacggtgaccgcgtcatggccgcggccgaggccgtgttcggcggcacgggcgcaacgctctctgccaaggtcgccggcatccactggcactaccggacccggtcccacgcggcggagctcacggccgggtactacaacacgcggggccacgacgggtacgcgccgatcgcgcgcatgctggccaagcgcggcgctgtgctcaacttcacgtgcatggagatgaaggacgagcagcagccgcagcacgccagctgctcccccgagctgctggtgcagcaggtcaaggctgcgaccagcgccgccggcgtgcagctcgccggcgagaacgcgctggagcggtacgacgatgcggcgttctcgcaggtggtgtcgacggcgcgcggcgcaggcctggccgcgttcacgtatctgcgcatgaacaagacgctcttcgacggcgacaactgggggcggttcgtgtccttcgtcagggctatggccgacggtggcgcgaggccagcgctgccgcggtgtgacacggggcactcggacctgtacgtcgggtttgtcgacgccgccaaggagaggaaggcggcggaggccaagggcgccgccaccaccgcagcattgtaggtggtcgtcggtagatgcccatgcatgtgcttgcataatgcatacagacacatgcgccgagctgttgtataacgtacacaggagaactgtataaattcagggccttcaggttgcaaagttttataggctgtaatcgagcaggtagataaggaggcaggcatgtcagaacttaggctatcttcagtttatttgttccatttcaaactgtattataaggagcagcttggtgactttcactgtcataaatttagctgaaggaaaatagaaatgccaattactac

SEQ ID NO: 7438 - DNA, 787 bp, Zea mays
ttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 7439 - DNA, 1709 bp, Zea mays
caacctcagcggcgaaatcccagccgagataggcaaggtgaagagcctgcagatcgcgctgaaccttagctccaaccacttcaccgggccgctgccccgcgagctcgggcggctcgataagctcgtcgtgttggacttgtcgcgcaacgagatatccggccagatcccaggcgacatgagagggatgcttagcttgatcgaggtcaatctgtcgaacaaccggctcgcgggcgccataccggtgttcggaccgttccagaagagcgcggcctccagcttctccggcaatgccgagctgtgcggcgacccgctgaccgtagactgtggatcatcaatctatggctccagctatggaacggagacggaccacaggggaatatcttacagggtggccttggcagtcgttggttcctgcgtgctcatcttctcgctggtgtcgttgctggtggcgttgttcatgtggcgcgagaggcaggagaaggaggaggaggaggcgaagaagaaggcggcggaggtggcggtggcggcagcagccccacaggtggtggcctcggccgtgttcgtcgagagcctgcagcaggccatcgatttccagagctgcgtgaaggcgacgttcaaagacgagaacgaggtgggcgacgggacgttcagcaccacctacagagccgtcatgccctccggcacggtggtgtcggtgaagaagctcaagtccgtggaccgcgcggtcgtccagcagcggacgaaggtggtccgcgagctggagcgcctcgcccacatcggccacgagaacctggtccggcccatcgggtacgtcctctacgacgacgtcgcgctgctgctgcaccagcacctggcgaacggcaccctgctccagctgctgcacgacaacggcgagaggcggaaggctgactggcccaggctgctgtccatcgccgtcgacgtcgcccaggggctggcgttcctccaccaggtggccaccgtccacctcgacgtctgctcggggaacgtgttcctcgactcgcgctacaacgcgctgctcggcgaggtcgagatctccaggctgctggacccgacgaagggcacggccagcatcagcgcggtcgccggctcgttcggctacattcctccagagtatgcgtacacgatgcgggtgacggtgccgggcaacgtgtacagcttcggggtggtgctgctggagatcctgacgtcgaagctgcccgccgtggacgaggcgttcggcgagggcgtggacctcgtgaagtgggtgcacgcggcgccggcgaggggcgagacgccggagcagatcatggacccgcggctgagcgccgtgtcgttcgcgtggcgccggcagatgctggccgtgctcagggtcgccatgctgtgcacggagcgcgcccccgcgaagcggccccggatgaagaaggtggtggaaatgctgcaggaggccagggacagctgagtggtctggttcctctgctcaatgatgtgtggttggctgcttggaacttggaacttggaagtcgaggcgagaaactctgaactgatcatcgttggagttcgagtatggagtccatccggtagcgtttgattctctgtatatattcggtaattagtatcccgatcatgcgccatggatcactggatgttcggtcttggagcaatgtctggaactctggatgcgtctttagcaaagcaattcggtgttctgc

SEQ ID NO: 7440 - DNA, 1085 bp, Zea mays
cggacgcgtgggcgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatctaaaaa

SEQ ID NO: 7441 - DNA, 1210 bp, Zea mays
caaggccgatctggggttggagggccggccatggtgatgatgatgcggtcgtgcctcggcggcggcctgctaccggtggcggtcatgctctgcctcaacgtggtggcggcggtcatggtgtcgctcgtcaaggtggccatggacggcggcatgaaaccgctcgtgatcgtcaccctgcagcagctcaccgccgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgtggccctgcgctacaccacggccaccttcgtgaccgccttctccaacatcgcccccgtgctcaccttcctcctggccgtcgctacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccaccagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaagcgtgctgggatcagtgctagtgataggtggcctttaccttctgctgtggggcaagaggcaggaggccctgcactgtcctcctcctcctccaaaggttgccgaagaagaccctgctgacaaagagcagcagcaagtgcagctcaactgaagacggacagcatcctctgactgtttggtcgtttggttgtaacagtgccagcaataagatctctctgcctccttttcttttt

SEQ ID NO: 7442 - DNA, 999 bp, Zea mays
cgcctcagatctactccaacacctccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaat

SEQ ID NO: 7443 - DNA, 1327 bp, Zea mays
ccacgcgtccgcggacgcgtgggtggcaccaccgcctcccctcctctccttattaccaccacctagctagcagcggcagcggcagcgccggcctgttgtgctgctcgctcagacagctctgctagctgcatcctcctaattctccaggtctctctctcctctcccaactcccaagtcccatccggatccgagacgctggaggcggagcgcccccccgggacggcggcggcgacgatggggcgcggcaagatcgagatcaagcggatcgagaacgccaccaaccgccaggtgacctactccaagcgccggacggggatcatgaagaaggcgcgcgagctcaccgtgctctgcgacgcccaggtcgccatcatcatgttctcctccaccggcaagtaccacgagttctgcagccccggaaccgacatcaagaccatctttgaccggtaccagcaggccatcgggaccagcctatggatcgagcagtatgagaatatgcagcgcacgctgagccatctcaaggacatcaatcgtggtctgcgcacagagattaggcaaaggatgggcgaggatctggacagtctggacttcgacgagctgcgcggcctcgagcaaaacgtcgacgcggctctcaaggaggttcgccataggaagtaccatgtgatcagcacgcagactgatacctacaagaaaaaggtgaagcactcgcacgaggcgtacaagaacctgcagcaggagctaggcatgcgggaggacccggcgttcgggtacgtggacaacacgggcgccggcgtcgcctgggacggcgcggcggcgctgggcggcgccccgccggacatgtacgccttccgcgtggtgcccagccagcccaacctgcacggcatggcctacggcttccacgacctccgcctgggctagcgcatccatcaccatgctgggtggtgctgctcgatcatcctactgcatggcaatgcaagctctggttggttggttcgctcatgcatcgtccgtcaacaaagcaagtaagcaatgcaatgcaaccgaggtactgtaatagccaataaaatctactgcatactgcaaacccaattactggtagcttagctaccgcgtgtgtacgaatcaaccgattaattaccgcgccctagcttgcatgtcgtcgtctgtgcttttggcgttcgtagacatgtatgtattgtatgcatgggtcctgttcatctgcatccatatgcatgttgtttatgattgtaattgttgtgtgaaatggctgtactttgctatgatcacgtgaaattatatctacattcgtgagactaaaaaaaaaaaaaaa

SEQ ID NO: 7444 - DNA, 1087 bp, Zea mays
acagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggattcaagaaggatgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgctgatccttcggttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtggtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattg

SEQ ID NO: 7445 - DNA, 852 bp, Zea mays
acccaacctcccactgtaaaaaagagcagcggaacgtgcgtgcatccatccatccatccatttccaatcccaatcccaatcccaccagtgtccagtgctcggggaaccgacacagctcctcagcagagtagccagcacgacaagcccgatcagcagacagcaggcatggcactcgcggaggccgacgacggcgcggtggtcttcggcgaggagcaggaggcgctggtgctcaagtcgtgggccgtcatgaagaaggacgccgccaacctgggcctccgcttctttctcaaggtcttcgagatcgcgccgtcggcgaagcagatgttctcgttcctgcgcgactccgacgtgccgctggagaagaaccccaagctcaagacgcacgccatgtccgtcttcgtcatgacctgcgaggcggcggcgcagcttcgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgctttagcaatttctctctggagggagcgtgtattgttatcttgtgatcgagagcctgtgtgctgcctttgcttcttgtgattatatagctactgaataaagatgtagcgttcttcagcct

SEQ ID NO: 7446 - DNA, 741 bp, Zea mays
gatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttggtggtgtctactactatgtctactttatgttgtcctaatggttgtaagtattttgggagtcactttgcttgcgaatgtctcgcgtaagacttatgttggtcaatggtcggttattaacttattaccatg

SEQ ID NO: 7447 - DNA, 1377 bp, Zea mays
ccacctctctctctctctctctctctctctctctctctctcttgttgggacctggagaagaggaaggaacagggagcaggggggaagaagaggttgctgcgacggctcaagcctcaaatttttggatccaggcagacaagcagagaaacaccagttggtcaagatgtcagctggtttccagctcggtgtgatcgggtcacttgcactctctgtcgcatcctcagttgccattgtcatctgcaacaaagctctcatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctgaggcttttcttgtagtttaggtctagtatgaactgcccttcgaatttaaaggacctggaaagccattcttttcattcttgagttcctttttaggaaacggagcttttaaaatttgtatagaatgcatattttgacattaaaattattatttgattgtattctacacacagcagttccagctgaagttttact

SEQ ID NO: 7448 - DNA, 1492 bp, Zea mays
ttcactcactaacggccgtgcttgcactcgcagcgcatcacttgctactttggtagtggagagcagaaagaacagagctagattattcccaacaagctacagcaaattagttgctcttcatggccgtgtcacacaacgttgggagcaagcacggtgtcgcgccgctggaggtgtcggtggaggccgggaacggcggagccgccgagtggctggacgacgatggccggcctcgccgcacgggcacgttctggacggccagcgcgcacatcgtcaccgccgtcatcggctccggggtgctctcgctcgcctgggcgatcgcgcagctgggctgggtcgccggccccgccgccatgctcctcttcgccttcgtcacatactacaccgccacgctgctcgccgagtgctaccgcacgggcgacccggagacgggcaagcgcaactacacctacatggacgccgtgcgctccaacctcggcggcgccaaggtcgcgttctgcggcgtcatacagtacgccaacctcgtcggcgtcgccatcggctacaccatcgcggcgtccatcagcatgaaggccgtcaggagagctgggtgcttccacgcccacgggcacgctgatccctgcaacagctccagcaccccgtacatgatcctcttcggcgtcgtgcagatcctcttctcgcagatacccgacttcgaccagatttggtggctctccattgtcgccgccgtcatgtccttcacttactcttccatcgggctctccctcggcatcgcacagaccatctccaatggtgggttcatgggcagtctcactggcatcagcatcggcgccggtgtcacctccacgcagaagatctggcatacgcttcaggcattcggagacatcgccttcgcctactccttctccaacatcctcatcgagatccaagacacgatcaaggcaccgccaccgtcggagtccaaggtgatgcagaaggcgacgcgcctcagcgtggcgacgaccaccatcttctacatgctgtgcgggtgcatggggtacgcggcgttcggcgacaaggcgccggacaacctcctcaccggcttcggcttcttcgagccgttctggctcatcgacatcgccaacgtcgccatcgtcgtgcacctggtcggcgcgtaccaggtgttctgccagcccatcttcgccttcgtcgagcgccgcgccgccgcggcctggcccgacagcgccttcgtctcccaggagctccgcgtgggccccttcgcggtcagcgtgttccgcctgacatggcggtcgtccttcgtgtgcgtcaccaccgtcgttgccatgctgctgccgttcttcggcaacgtggtggggttcctcggcgccgtctccttctggccgctcaccgtctacttccccgtcgagatgtacatcaagcagcgccgcgtgccgcgcggcagcaccaagtggatctgtctccagacgctcagcgtcagctgcctcctcgtctccgt

SEQ ID NO: 7449 - DNA, 952 bp, Zea mays
gaagcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaat

SEQ ID NO: 7450 - DNA, 1334 bp, Zea mays
cccgtcgtctcgcctgggttctcgcttgcttctcaccatcactaccaccgtccacaccatcgcgagggcctggagggaagaggatgggacagggaggagaagtgaaggcggcgccggccgtgagggtgctggtggtggacgactcccccgtcgaccgcaaggtcgtggagctgctgctccggaaccacaaccaccagggcggcgccgcgccattccacggtcagcggctcctgctcctcagctcctcgcttgctcccctctcgtccggtcccttccgttccgtctggccactccattcctcccctctgctggtctcgacgacccttctcggcggcccgtgtactctgatccgggattatggctatgcataggaattgcatggcatgatcaagcttcatccattcgtcgtctgtcagttgcttatcagtactgttgaagaaaaaacgaaattaaatttccgcagcatgaactaattaaggcccgggtttcgttcctttcctcgtttggttcagttaccgccgtcgacagcggcaagaaggcaatggagcatctccggctgatggagcaaggcggccagctggattcatgtgccgctgatgctaatcggataaccattgacatcgtgctcacggactactgcatgccggagatgactggctacgacctgctcaaggccatcaaggcgctgagctcccctaacccgatcccggtggtggtgatgtcgtcggagaacgagccccagaggatcagcagatgcctaaccgccggtgccgaggatttcatcctcaagccactcaagaccaaggacgtgcagcgcctgcgcaactgctccagcgccgctagacccagggacgacgcggcccaccagtgcgagagcttgaggaggagcagcagaaagctgcggtcggatcaggtcgccgcgcctggccacagatcgcaaccgacgacgggattaaccatggtactgttattcatcgtttcttgctgttcctccttcagaagatcagccagagcttataatttcaatggatgccccccacccccaggtgctgcatgcctccagcattgagctctcgcactacttccagttcctcctcaagttcgtgctgctcgcgtacgcggtgctgtgcctgaccgagctcctccacagatggtccaatggctccgtcctctccctgtggtctgcatgaggtcgactggaaccgcgatgcggtattattagtgtaaccactaaggctccaggctttcagttcaattcccccctgtaatccagtcctggcatgaggagccaccagttcttgctcgccgctccctatatttccatttcacttttc

SEQ ID NO: 7451 - DNA, 1703 bp, Zea mays; identical to SEQ ID NO: 1998

SEQ ID NO: 7452 - DNA, 1197 bp, Zea mays
acagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggacatgttttttctgagttctacacctgcttgtcttgcttatgtgacggtggagtattgtgcctttaatatcaacctaatcatggactggttc

SEQ ID NO: 7453 - DNA, 2029 bp, Zea mays
caaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctgccgtgttatagccagattaaagaaggaaagagatgacgctagagcacttttggctcaagctgagagacagattcctgcgtcagttgcaggagctgctcctgcagctgttgtttccaatggaaaaagagtaattgaagatgaaattggccctgacgggaagaagatccgtcctggtatcaaccctgtcatgattgatgaacttacagagtgtaatgccatgctttcagcacagcgcaagaaaagacaggttcctccaactctggcaccgatcgatgcactcgagagatacactcagatctccagccatccccttcataagacaaacaaaccaggcattttgtccatggatattcatccttcaaaggacattgttgcaactgggggtatcgatacaaatgcagtaatctttgatcgttcatctggtcaaatcttgtgcacgcttgctggtcactcaaagaagataaccactttgaagtttattccacgggatcaactctttgtaactggatcagcagataagactgttcgcatctggcaagagaatgagaatggaaactataactgtgtccatacactgaaagatcatactgatgaggttgaagctgttacagtacatgtgactcagaagtattttgtgagtgcttccaaggataactcttggtgcttctatgatatttcaacaggatcttgcctgacacaggttggcgatgcttcaggacaagagggatatacatctgcgtctttccatccagatggtcttatccttggaacaggaactactgatgctgttgttaaaatttgggacgtgaaggctcagtcaaatgtcgcaaagtttgagggtcatgtcggaccagtcactgctatgtctttctctgaaaatggttacttcctagcgactgctgctcatgatggtgttaagctttgggatcttcgtaaattaagaaattttaggactttctctccctatgatttggacacgccaaccaatactgtggaatttgattttagtggaaactatcttgccattggtggttcagatataagggtctaccaagtagctaatgttaaggccgaatggaatcttatcaagacattacccgatttatcaggaacagggaaagtaacttccgtaaaattcggagtagacgcgaaatacatagccataggttctatggaccgcaatctacggatatttggtctccctggagatgatcaaatggaggaatcaaacacagcggccgagtgatgggaattcatggtgcctaatttgtttcttctgccatcatcctcattatactgtggtgatggatagactgattgcacatggatacatcaccgtcacaagagggaagggtcctggcggggattactggtctgagcttcggctggtgtaaaacaagctgtgatattgttgtactgtaggccttactaattcttctgatgaggatacaatttgttttgttgactacgatgctaaacagctaaagttctctgcgcagattccagtgattcaaaacg

SEQ ID NO: 7454 - DNA, 1161 bp, Zea mays
ccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctggccgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggaatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtattctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccggccggccgcgccaggagctgggcaccgttccaattctgttcctccccatgacgccctgttctgtttccgtgtggccaggactccgctcgctcgctgctgttttctacttcggaccaaagtgtgacatatctttgctttctgtatatgtatgtaggaatgcatcatgtaaggagaatttggaatacaattgcgtgagtttttatcc

SEQ ID NO: 7455 - DNA, 1561 bp, Zea mays
tccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttt

SEQ ID NO: 7456 - DNA, 1123 bp, Zea mays
cgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaac

SEQ ID NO: 7457 - DNA, 1132 bp, Zea mays
aagacgtcaaaggggattccaccggcgggaagcgattgcgagtacttatggttgtccctttggtgagggctgccattttgtccattacttccctggtgactaccgggccgtttcagaaatgaccaacctgggtggcgcaacaatcgcacctcctggaggaatgatgatggatgggccacctacacccatcgtgaagactcgcttgtgcaacaagtacaacactgcagagggatgcaaatggggggacagatgccactttgcacatggtgaaagtgagcttggcaagtctatgatggacaactatatgccaccccccatcggaccaccaccaaccggttattttgcacctccacctatggcacctccacctatggcgcctccacccatggcacctccacctatggcacctctacctatggcgcctccacccatggcacctccacctatggcgcctccacccatggcacctccacctatggcgcctctacctatggcgcctccacctatggcacctccacctatggcacctccacccatggcgcctccacccatggcacctctacctatggcgcctccacccatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgtcacaggggccaaggtggtcattcaggaggaccgccatgaatcagacaccagcttgaaaaacattgagtttgagggcacctttgatcagatcaggaacgctagtgctatggtcatcgagctgattgttagcatcagtggcataggaagcaacttcaagaccaagatgtgtgagaacttcgcaaaagggtcatgctcttatggcggcaaatgccactttgcccatggtgagagtgagctgcgcaagcctgccgctgcttgagatccatgccctgtttcttacctcatagtcattagtcaatgtaactcaaaacttggcctctgatgatggatttgttggcttctttaggtctacgctaatgaattgctggcttcaggcctactactaaatttgctgacttctttagtc

SEQ ID NO: 7458 - DNA, 1593 bp, Zea mays
gtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatgagtaagacgggtttctggtgtcgattccttctgagtttttttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataagggttgttttcgtg

SEQ ID NO: 7459 - DNA, 1070 bp, Zea mays
gcattcatcactttcctgactcacctcactcgatcatcctccagtcttgtcgtcgcctgctagcttgaatattacgccagcatctcgccaggaaaatggcgggcactactccgcgccgcttgctcctggtcatcgtccccctcgtcgccgtcgtgccggcgtccgcaaaagactacatggtcggcgactcgtccgggtggaagtccggagtggactacgctgcctgggccaagggcaagccgttcgccatcggcgacacgctctgtacgtgccaaataaagctcgtcgtcagattcagatacgtacagtacagtagccgccaatgctgtgtccatgcatgcatcatgttctcgtatataatgtcagtggcacgttcgttcgatcgtccgcgtgtatatctcagtatctcgtgaaggagaaatccagtgaccccgcgcggcctgccggttcttgcgttgcagcgttccagtacagctcggcgcactcggtgctggaggtgagcgaggcggaccacggcgcgtgctcggcgagcaacccgctgcggtcgcaccagggccagagcaccaccatcccgctcaccaaggccggcacccgctacttcatctgcggcgcccccggccactgcgcctcgggcatgaaggtcgccatcaccgtctccggcggcggcggcggcggcagcagcagcgccgacaacaccgcgactccgtcgggtccctccgtgcgggcgatgaacacgaagccggcgttcggtctccggtccggtggcgcgacgacgacggacgagtcggactccagcgcggctggcagcggcgcccgcctcgcgatgggcctgctgttcggggccgcgggcctcgctgcaataatgggctgaattgaggacccgctagggaaaaggcagtgcggtttcacgaatttcctatttagtttcctgcgttctctgcttgcgtccccgagtcgcgaggctgagtgttcggccgtgcatatttttcgtatacttttgctgtgtttttttggggctattcgttgttcaatactgttgtttcagaataaaatttcatccttgaccattc

SEQ ID NO: 7460 - DNA, 825 bp, Zea mays; identical to SEQ ID NO: 7336

SEQ ID NO: 7461 - DNA, 1545 bp, Zea mays
gttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcct

SEQ ID NO: 7462 - DNA, 2151 bp, Zea mays
cagacaaggaggaggaaaactcgaactgtgatggtggggaatgtgccacttggcagtgatcaccccataaggattcaaaccatgacgacttcagataccaaggatgttgcgaaaacagtagaggaggtgatgaggatagcagataaaggagctgatcttgttagaataacagtccagggtaggaaggaagctgatgcctgctttgagatcaagaacactctggttcagaagaattacaacattccactagtggccgatattcattttgctcctacggtagctctaagggtggcagaatgttttgacaaaattcgtgtgaacccaggaaattttgctgatcgtcgtgctcaatttgaaaagctggaatatactgacgacgactaccaaaaagagctagagcatattgagaaggtgttttctccattagtcgagaaatgcaagcagtatggaagagcaatgcgaataggaacaaatcatggtagtctttctgaccgcataatgagctactatggtgattctccacggggaatggttgagtctgctttggaatttgctagaatatgtcggaagttggacttccacaactttgtattttcgatgaaagctagtaaccctgttatcatggtccaagcatatcgcctgcttgtggcagaaatgtataacctaggatgggattatcccttgcacttgggtgttacagaagctggagagggtgaagatggaaggatgaaatctgctattggcattgggacactgctaatggatggtttgggtgatacaatccgtgtctccctcacagaaccaccagaagaagagattgatccttgccaaaggttggcaaatcttgggacgcaggctgcaaaccttcaaattggggtggctccatttgaagaaaagcacaggcgttattttgatttccagcgtaggagtggtcaattgcctttgcagaaggagggtgaggaagttgactacagaaatgtcctgcatcgtgatggttctgtactgatgtcagtttccctggatcagttgatggctcctgatctcctttataggtctcttgcagcaaagcttgtggttggcatgcctttcaaggatctggctactgtagattccattcttttgagggagctcccccctgtagaagatgctgaagctaggcttgcactcaaaagattagttgacatcagcatgggcgtgctggcccccttatcggagcagttgacaaagccactcccacatgcaattgtacttgtcaacctcgacgaattgtcaagtggtgcacacaaacttttgccagaaggcactagactagctgtcactcttcgtggtgatgaatcatacgagcagctagatattcttaaggatgttgatgatataacaatgttgttacataatgttccatatggtgaggagaagacaggcagggtgcatgctgctaggaggttatttgagtacttacaggccaatggcttgaacttccctgtaattcatcacataaatttccctgaaaccattgacagagatggtcttgtcattggtgctggggccaacgttggtgctctcttagtcgatggtcttggtgatggtgtattccttgaagctgctgaccaggaatttgagtttctgagggacacatctttcaacttgctccaaggttgcaggatgcgcaacacaaaaactgaatatgtgtcttgtccttcctgcggccgaacactctttgaccttcaggaaatcagcgctgagattagagaaaagacctctcatctgccaggtgtctcgatcgctatcatgggctgtattgtcaatggaccaggagagatggctgatgccgattttgggtacgttggaggcgctcccggaaagatcgacctttacgtcggcaagaccgttgtgcagcgcggcatcgccatggaaggtgccactgacgccttgatccagctgatcaaggaccatggccgatgggtggatcctcctgccgaggagtagggctgtaggctgtagccaagtctgtagtttatatattctgtaaagcgaaacacgcaatgcagtaactgagcatacgatgtacatcatccctacacattttgtacatttattgagatctgagaaataaactagaaaccgtcggtgacggcatgtctgcagcacccc

SEQ ID NO: 7463 - DNA, 1444 bp, Zea mays
gcggtgagcccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgcc

SEQ ID NO: 7464 - DNA, 2682 bp, Zea mays
cgcagctccccacttctcatcgccccctttttttaatttgtggccatctttggggtggtgggcggaggatttctaactggatggtgaagtttgtctggcgaaaaggacggctgcgacgaacccgtccatcgatccaacgctgtgcgcgcgttgggggagggacctgccaggccccacctgcagcgacagactattgatagatgccttcctctctgatcacctgatggctgatgccttcgcggccgtcttcgcctgccgctgctactactagttgccttcctcgcttccccgtctcgccccagccgcttcccctctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatgacggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgcccccagcgccgctcccgcccgcgacgccggccccaaggctcgcgtccacatcgtccaccgtcacaagtggcgccgccgccggtgctggctacttcgatctcccgcccgccgtggactcgtccagcagtacctacgctctgaagccgatcccctcgccggtggcggcgccgtcggccgacccgtccacggactcggcgcgggagcccaagcggatgaggactggcggcggcagcacgtcctcctcctcttcctcgtcgtcatccatggatggcggtcgcactaggagctccgtggtcgaagctgcgccgccggcgacgcaagcatccgcggcggccaacgggcccgcggtgccagtggtggtggtggacacgcaggaggccgggatccggctcgtgcacgcgctgctggcgtgcgcggaggccgtgcagcaggagaacttctctgcggcggaggcgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttacacgcgcacttctacgagtcctgcccctacctgaagttcgcccacttcaccgcgaaccaggccatcctcgaggccttcgccggctgccgccgcgtccacgtcgtcgacttcggcatcaagcaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacaccatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctcgagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgctgggccagtggcgcagccgcctcggcggctccgggttcgcgcccgtgcacctgggctccaatgcctacaagcaggcgagcacgctgctggcgctcttcgccggcggcgacgggtacagggtggaggagaaggacgggtgcctgaccctggggtggcatacgcgcccgctcatcgccacctcggcgtggcgcgtcgccgccgccgccgctccgtgatcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaaatgtcaattattatgtgtaattcctccaagcgccgatatccaataaggacgaaccggattttcgtt

SEQ ID NO: 7465 - DNA, 1461 bp, Zea mays
ttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggccgttgtgtgctatgaagttcgctacactggcctgtcagttatcttttgcatgcatatgcattatcatatacgcagtcgcgtagcaggtttccttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaagacggatcctgatttgcgttg

SEQ ID NO: 7466 - DNA, 682 bp, Zea mays
gcggaaaagctaaaacattttataatttggaacggagtatttgacttccgcgagcagatgttctccttcctgcgcgacgccggcgacgcgccgctggagaaacaccccaagctcaaggcccacgccgtcaccgtcttcgttatggcatgcgagtcggcgacgcagctgagaagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaagaggcctacgaccagctggccgccgtcatcaaggaggagatgaagaacgccgccgccgccgaggagcagacgaagaacgccgccaccgccgaggaggagattaagaacgccgccgccgccgaggaggagacgacgaacgccgccgcggctgttgatggttcctagctcccactacgctcctctgctagcgaccgtggcacgcgcaccgctgcgttgatgggtgcttttggactgctgctggcctgatacctacctacgaagctgttgctaatgctgctgcatttttgtttgtcgaccgcatcattgtgatgataaataaaatgttcagaaaatgcccgtt

SEQ ID NO: 7467 - DNA, 1658 bp, Zea mays
gatcaaccgctcgaaattcgggggaagcaagcgagagcagcagtaagcctcatcgggaagtggagagatggaggcggcgggtcgcctcctcctcctcatcgtctcctccctcctcctgctcttctcgccggagcggccggcggaggccgcgccgccgcgaatccagccgctcgccaccgccgcgctgagccgcctctacgacacctccaactacggcaggctgcagctcaacaacggcctcgcgctcactccgcagatggggtggaacagctggaatttcttcgcctgcaacattaacgagacggtcatccgcgagacagctgatgcgctggtgtccacgggactggctgcgctgggctacaacttcgtaaatatcgatgattgctggtcatacgtgaaacgaggaaagcaggatcaattgctgcctgatccaaagactttcccttcaggcgtcaaagcacttgcagattatgtgcatggaaaaggtctgaaacttggtatatactctgatgctgggaaatttacttgccaagttcgacctggatcactcggtcatgaaaatgacgatgctgcgatctttgcttcatggggtattgattacctgaagtatgataactgctacaatttgggaataaagcctcagaaaagatatcctcctatgcgagatgctcttaattcaactgggcgccaaatattctactctttgtgtgaatggggccagtatgatccagccttatgggctggcaaagtgggcaatagttggcgtacaactgacgacataacggatacatggaaaagcatgacagacattgctgacaagaacaacaagtgggcatcatatgctggacctggtggttggaatgacccagatatgctggaagtaggcaatggtggcatgagcttagcagagtatcgctcacattttagcatatgggctctcatgaaggcccctctattaattggctgtgatgtcagaaacatgacttctgaaacaatggaaatactgagcaacaaagaagtaattcaagtaaaccaagatcctcttggagttcaaggaagaaaaattttaggacaaggaaaatatggatgccgtgaggtgtgggctggtcccttgtctgggaatcgtcttgttgttgctctgtggaaccgttgttcagatactgctaacgttacaatgaaactgccagcagtaggccttgatgggtatgctgcctattctgttagggatctgtggaagcatgaaactctatcggaaaatgtcgtaggaacttttggcgctcaagttgacgtgcatgacaccaagatgtacatcttttctcctgcaaccattgtcgcttcggtttgatcaggaccggtggatccaagatgacagcaccgctattgttcaaggatatgtcacgacaacaagcgccttcggttttcctgctgcattctgttccacccgactgcagaagtccacttcgtgcagaactgtctcagtgatgtttgtatttctcacggaatagctctatttatctcaagattgagcaagctcgcggcttactcggtgtaccggcgttgtatccttggggcatccaggatcttgtacgatttgaaacagtctgaaccaatgatgtaaaacaagatagtgaaaatacaacttcacaaattgcagccgt

SEQ ID NO: 7468 - DNA, 1197 bp, Zea mays
ccgaaggtatctgtattccttgatcaacatgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgccttcaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctcgaagggcgatgctggtgagggtcagtagcctggtaaacttagattgatggttcgacgtgtttctcaagcacatcgtgttggacgcccagtgctgacagaaggcttttgctgctccatgcattccaagcttctgccctttcgttcgcaccctcttcatgttgttggctggtagtggtcagatttagtcccattggtttagttggccctgggtccatctgaactgatgtattgttactgctatggaagtcattcctttagttttgctctggcagtggattgctgttgggtcgtgttttcagtctttattggttccgatcggacgctgttgcggcaaaccacccctgtagatactcttcacatgctgaagaaaactaccagcagccgtttagcctgaataattgttaaatgataggttaccgttgaggctgattggttttt

SEQ ID NO: 7469 - DNA, 604 bp, Zea mays
aattgatgaaccattcaaagccttgggtgttgattacacaggagatgttgtgattccaagcttggagagtcataatgtccgtcagctttatccaaagggtcccaatattgacttcaagaaggagcttaggaccctcaacagagagcttcaattgcatattttggagctggcagatatattagttgagagaccatctcaatatgctcgtagggtagaagatattacgctcatattcaagaacttacatcatcttctcaattccttacgacctcatcaggcaagggccacattgattcacatgcttgagagccaaattcggcaccgcaaggaagcaattgaagatataaagcagaggagggaggaagcgcaaaaaatgcttggggaatcactgcttatcttggatggaagtcaaactaactaggctgacgccgtcaagttagttggttcaagaccgattcttctatgagttaaagagtgttagtagaagacaagatgtgtctggattgttgtggtatcatctgttgtggcttgtggtatttccagctttgataactgaattttcttacttctatggtctatgttagcaaagttggattactttctt

SEQ ID NO: 7470 - DNA, 1480 bp, Zea mays
gggagaaagataggagtcaattaatttgcctgttctgcttgctgctgaccttgtgagtgagccgccggtcttccccttcctcgccgaggggaaataataaggcagccacagccagggccgccccgaggaagaagatgagcggaggaggcgtggacggagctccggtcgccgagttccggcagacggtgacgcacggcggccggttcctgcagtacaacatcttcggcaacctgttcgagatcacgcacaagtaccagccccccatcatgcccatcggccgcggcgcctacgggatcgtctgctcggtgatgaactccgagacgaaggagatggtggccatcaagaagatcgccaacgccttcgacaaccacatggacgccaagcgcacgctccgggagatcaagctgctgaggcacctcgaccacgagaacatcatcggcatcagggacgtgatcccgccgcccgtcccgcaggcgttcaacgacgtgtacatcgggacggagctgatggacacggacctgcaccacatcatccggtccaaccaggagctctcggaggagcactcccagtacttcatgtaccagatcctccgcgggctcaagtacatccactccgccaacgtgatccaccgcgacctcaagcccagcaacctgctggtgaacgccaactgcgacctcaagatctgcgacttcgggctggcgcgcccgtcctccgagagcgacatgatgacggagtacgtggtcacgcgctggtaccgcgcgcccgagctgctgctcaactccaccgactactcggcggccatcgacgtctggtccgtcggctgcatcttcatggagctcatcaaccgccagccgctcttccccggacgcgaccacatgcaccagatgcgcctcataaccgaggtgatcgggacgcccacggacgatgagctcgggttcatccggaacgaggacgcgcggaagtacatgcgccacctcccgcagttcccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtggtttgtaaatagaagatcgagccggccgccggtgttattagactgaacgttgcatttgtttgttcgttgacgttcgcgctcgcaggtttcaggctgtgtagtctgctgcaggtttcaggtgttcgtgtaatgagctgtaccaagaataaaatgctttggact

SEQ ID NO: 7471 - DNA, 1194 bp, Zea mays
acagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggattcaagaaggatgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgctgatccttcggttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtggtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctgagttctacacctgcttgtcttgcttatgtgacggtgcagtattgtgcctttaatatcaacctaaacattgactggtt

SEQ ID NO: 7472 - DNA, 822 bp, Zea mays
ggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7473 - DNA, 1810 bp, Zea mays
cgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggag

SEQ ID NO: 7474 - DNA, 1950 bp, Zea mays
ccgggtgcactgatctgggggccgcgtgtccccggtggtggggcgaggcggcgccggcttccaggaatgggcaacttgtagcgtcggtttcttttgcatatgcactttctattgttgttgtcatttcaaaggaggccatagtctcctggattttgtatgccttgttatctggaattggtgaccatagatgtcattccgtagcatagtccgtgatgttagggatggctttggcagcttgtcgaggagaagctttgaggtgaccctcgcaagcatttatggccttactgggcatcacaaagggaagacccagagctcatcacatgttctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccagagttctgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttcctaggcacaagatttttaatttatgatacacaagccccctataatggggctgtagttcctcctgccggaaggaccagcaggaggttcaactccacaaaagtctctccaaagctgccttcagtcagttacaacatcgcacaggtatcgtatgagctaaatgtccttggcacaagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcgtccatggatttcaatagcgctcgcttctctgacatagctggcagcagcgctcgcttcacgggcgttcctggtagcagtgctcgctttgcgggcgttcctggcagcagcgctcgcttctcgggcattgctggcgccagattggacaacgacgaggagagtgaaaccaaggagaggccactggtgcttcgtaataagccgcctaggtggcacgaacagctgcagtgttggtgcctcaacttccggggccgtgtgacaattgcctcggtgaagaacttccagctgatcgccgcggctaccccgccacccgcaggtgcgccaaccccctcgcagcctgctccgtcagatcctgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacagcaggttgcttgcattaggccatcagtgtacctctttccatctggctctcgtgttgccttggttgtattttgtgcttaatgtagccatgaagttggtggccatatatggacgcatgtgttgttgttggccctctcccttagaaatgattaaaagttgcatttggaccacatgttacccgatctgtaatatacttgcagtggcattgcatgccgcgtgataacaaagttcccgttcgtgattggacttgtatggtttcagaaaagcagcaaacaaagtttggtacggtgtgc

SEQ ID NO: 7475 - DNA, 1533 bp, Zea mays
gcgcgacctctcggcgaaaccctaacctaccttagaccccgccgccgccgccgccgccgcccaagggagagagagacttgcacatcaaagggcgtccgatggggaagaagaagaagcgcgtcgataaggtcttctgctactactgcgaccgcgagttcgacgacgagaagatcctcgtccagcaccagaaggccaagcacttcaagtgccacgtatgccacaagaagctctccaccgcctctggcatggccatacacgtcctccaggtccacaaggagtccgtgaccaaggttcctaatgcaaagcctgatagggagtcaacggagatagagatatttggaatgcagggaattcctgcgcatgtattggctgctcattatggagaagaggaagacccttcaacaaaggtacccaaagtagaagtgcctcaggtaaggcctgttattatgcctaattcgctaggcatggcatttcctccgcgaccagcttatggtgtggcacctccaatctataatcctgcactcaatcctttgatggcccggcctccaatttggcctgctgcaccagcgcaagcttggtatccgcaacaagcagcatatccacaacaatcagctgtttcagttcctcccatagttgctgggctcccaccacaacagccactattcccaattcagaatgtgcctactcctatgacatcagcagctgctaatgtacttcaaacatcgtttcctatggcccctccaggagtaccttcacctgttgcccctcatgtttcccagcctttgtttcctgttaacacttcagctgtcaatggagctgtaaattccccatttttagcatctgttgcacctggaaccattccagcaagctcttcagcagcagtcggtgttgcaggaattggatatggaaccaataaccaaggcactagagatccagcagttggatcttcacctgcagtatccaataataaggcgtctggtgcccaaccagctacgaatgaggtatatctggtgtgggatgatgaagcaatgtcaatggaggaaagaaggttgtcgctgccaaagtatcaggtgcatgatgaaactagccagatgaactctgttgacgcagcaattgatcgaagaatatcagaaagtcggctggcaggacgcatggccctatgaagaagctgggctttgctcggtagattatcccccttgcatttcaccgaaggactctgcctgcgcttgtatctcgctgtgcagcagtctgccctcttcatttagttagcgaatggagttgctgcagttaagaggaatgtgttgtttctgacttgtttgagtgtcgagcctttgttcttctatgtttccagcatcgacaagaaaatgaattagtagcacttaggagttattttggtccaactgtcgcctcattgggaatatattgatgaacacctcaatccctgcccgattgtaacctggtcatgtgctattgccaattgaagcctaatgctgtgcattggcttgaaagcaacttaaaaatgttacggattat

SEQ ID NO: 7476 - DNA, 1755 bp, Zea mays
ggagagcaccttcatcatgatcaagcctgacggcgtccagaggggcctcgtaagcatcatgtgttcctagttcgtttctgttcattcgattcgatttggtgatgtccacgcgctttgtgatccgattttgtactagtttgtgttcactccatcctgcttggtttttttcagattggtgagatcatcagccgttttgagaagaagggcttctacctcaagggtaatctagcgtccatgttttgattcaaacttccattatgttcccaaacagccttaaatttctccatttaaaggctaaagatgtggctttagacggaaattcaacagtttgtgctcaaatgagttgtcgcttttcctaaatctgttgataaaattcagattttggtgcacacctgccaagtttttttgtaatctcattacggtttgtaaacaagccgtgcttgataacctgccaactcgaaatgcagccttgaagcttgtcaacgtggagaggtcgtttgccgagaagcactacgccgatctcgcctccaagcccttcttccagggcctcgttgactacatcatctctggccctgtggtggccatggtctgggagggcaagagcgtcgtcacaactggccgcaagatcattggcgccactaaccccctggcttctgagcccggcaccatccgtggcgactttgctgtcgacattggcaggttagatctcagtccgatttttgtatcttatggttttcagtcaccgttattcatccattggttatgcttagttgcttaatttgttaaagctgcccaatccaattgggactgccatacatccaatgtaaaaaaatgttcacactcctgagttcggcgtagttatatatcctaaaatttgcgcttttccatagtgatgctaaaattcttgactgactagcattggatttgtgtagagccacggttatttattttgtgtagtcaaattagatgttaagagacaatgcttgtagatgattatgaccaaatgttggctctcagttcattagtttgtttgtatcttggggtaatgaacatttgtggtcatctcatgattgcagccatgctgcagatcaactgttttaatgttggcattatgacctgttacatccaactcgtgggtccagtaggtacatcctctggcatgtgtttaccagatctgagcttatacttgttctgaatctgatgtggagtccacaaaacatttagacatcagtggatgtaagtgatgtactttcctggtgttgtggggactggttgctctggttgctgtttaatcatccatttaactcgtctttagccatgaatagttggggtgtactgtatcttattctgggtagttgtccatgagggttttgccgtattgtacttctgatttaatatagaaaacccattttttaaatgtagtgttaaagcctctcggattatgtctgttgtatcagattctactatgatgccaagttctcatgaccttgttttgtgctataggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaaaaatgtcaccatttgtgctttagcaatgttttcgaaaagattatgatctgtatcttggaaccttatttcaatggaccaaatttctttctttgcc

SEQ ID NO: 7477 - DNA, 1764 bp, Zea mays
gctctggacacatcagtctgttaatcctgaatgggagcaaagacatgtccaagttcaaccaggaagttcctattatgcaggcactgcaagtgatccatccaacctgggtgtgcaagttgctgtgggagttccaggaaatactgctaatgttggtatatgtgatttgcggaatcatgagtgcccgcatgttcataattcatacccacatgccggtgttacatcaagatttgtcttcccaactactatgtacagccctagcatgtcagcagcagctgtcaacatatatattcctcagactcaaagctttggactgggcagtgtgctaccaccatctttacataatcaagtttccacaggaattattgatgagagtagcagcagtgtcaattttggtgatagtgctattggattcatgaaaaggaaaaatgcagtagttgctggaagccataattttcttcatggatttgctgggtcaagttcatctgtccatgtgcctcagaatcctgtgcatggggcatggaatccttcatctcaatcaaattgtttacccagttctgcagcttcaaacctaccagaataccacaatagtaatgggtggccatacttagaagaatcttctgcagatgcttcaaacagtttcagttctgtggctgcttgcccggagctggcacctcatggtaactatttatatccagcttgtcacataagccagtccaatacatgggttccacagcctgcaggttacggagtaccacagtggggatatagtaatgcagtggtcaatcctccagacatgtcaaatgggccactgcctcatttctgccagaatagtatgcaggcacctcaaatacaagtgccccatcaacagtccatcggtaacaatgtggtgcatggtttaaatccttctgccacaggtcttcctttacatccaagaatgctggctctcccattcaatgctgagcacacttttgggcatccaatgcacccacctctgataaaccaagctaacaatggggctttaagaattctgccatatcagaacgctacagtgatggatcattcaaggatttatgaagcaggacatgttatcgatgaacatagcgatatgcgtttagatgtggataacatgacttatgaggaacttgtagcattgcaagagcagataggcgatgtcaatactggtttgacagaaagctatatccaggaaaacttgaggtccagttttcatgttccaggagcagctagcatgtctgatcagttttctgagctttctttggagaatgatgcttgcataatatgccaggaggagtataaagctaaagaacttataggaacccttgaatgcggtcacaagtaccatgtgaattgcataaagcaatggttgatgatgaaaaacctgtgccccatatgcaagacgacagctttgtcatcagatagaaggaacggatgaccgtcgccaataatgttgttggttgtttaccgcgtggcaaattagcgtggattttgtatatagacatggttgcctttatttgcccgtcccctttgctgtggacataaactgagcttcgaaacactgtacagatattttgtaggatgttttagacgttaaatggcacaatggtgtgtaaagctcccatgactgccttggtagatgccctcttcctttacattgtacattgtatttatctttactcttcaaaaaaagaagcttgaaaaccgtaagttctgtacattctggaattgaaagaaccggaaattttcttc

SEQ ID NO: 7478 - DNA, 866 bp, Zea mays
gggcgttcctctcccgtgtggattctccccacctccgccgccgtttccccgcgtgctttctctctctctctcgatctcgagcgacgactcggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattttattggtgttggct

SEQ ID NO: 7479 - DNA, 717 bp, Zea mays
ccatcttcccggttacgccgcctgatcgaagtgaacaagcaaggaagagccatggcgagcgagcacgcggcggggggcgaggctaagcatgaccagaagcagagcctgatggacaaggcgaaggggttcgttgtggagaagatcgcgcacatccccaagcccgaggcgacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcggactcaccgtcgacctccccatcgtcggcaacttcaccatcccgctctccacctccggcgagttcaagctccccaccctcaaggacttgttctgatctagtagtagctcgcttgccttctgttctgtgcgggcgcgcaccagcgatctgtacgacgagcttttgcaaataaacgacgcagctcctctgttctatatatctcagtgaatgcctaagctaaggggatggatggtttaataaataaagagctggatttcattc

SEQ ID NO: 7480 - DNA, 1225 bp, Zea mays
ctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttattaaatttgcttgttt

SEQ ID NO: 7481 - DNA, 2436 bp, Zea mays
gattctgacggcggcgatgacgaggaggaagaagaggtccgccccgggggtggggacgcgggcccggggttctcgctggccatcgagggcgtgctgggcgcgtgcggcatggtggtctccgacgcgctcgagcccgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgctagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatgaatatcaacagttccatcttaccgcg

SEQ ID NO: 7482 - DNA, 2056 bp, Zea mays
gtccctcagcgaccaagtggtcaatctgctcaacaaacagaagcgatgagtggtctgcccctttatgatagccacaacgttgaggatgaaaatggctcacagaagtttgtctgcagattatgtgggctcaaatttgatcttctgccagatcttggccgccaccataaagtcgctcatatggtctcaggtgctgttggccacattccactgggccgtgggaagtaccagcttaaccgcggccgacactactattccgctttcaagaaaagtttgcgaccaacaagtacattaaagaagagcagtagctctggaatcgataaaaatttgaagtttcagatctctggcttaacatctcaaatagttgaatctgaaacatccagccttggtaagttacaggatttccatgcttagatgttgcacaaactttattttccaagattcaaaagacaagaccccatccaagcaactttgatgttttatcggttgcccgctctgtatgctgtaagacaagtcttcttgctgcgttggaagttaaatacggacctttacctgagaacatatttgtgaaagctgcaaagctttgcagtgacaatggcatccaaattgattggcatcaagagggattcatatgccctaaagggtgcaagtctagatataattcaaatgctctgcttcctatgcaactcacggcagttgattttcttgaagctcctgttgattcccgtaatgatgatgaaatgtggggaatggaagaataccattatgttcttgattcaaagcacttcggatggaagcctaaaaatgagagtgttgttctctgtgaagacataagctttggcagggagaaagttccaattgtctgtgtcattgatgtggatgcaaaagattctttaggtatgaagcctgaagaacttttgccacatggcagttctttgccttgggaaggatttcactatatcacaaaccgtgtgatggattcatctcttattgattcagagaactctatgcctgggtgtgcatgttctcatcctgaatgttctcctgagaactgtggtcacgtgagtctctttgatggtgtctacaatagcctggtggatatcaatggaacaccaatgcatggcagatttgcatatgatgaagatagtaaaattattttacaggaagggtatccaatatatgagtgcaattcatcatgtatttgtgactcgtcctgccagaataaagtattgcagaaagggctgcttgttaagttggaactctttagaagtgagaataagggttgggctattagggctgctgaacctattctacagggtacctttgtctgcgagtatattggtgaagttgtgaaggctgacaaggctatgaaaaatgcagaaagtgtgtcatcaaagggtgggtgcagttacttgtttagcattgcttcccagattgatagggaaagagttcggactgtaggggctattgaatactttattgatgccacaaggtctggaaatgtttcccgttatattagtcacagttgttccccgaatctcagtacccggttggttttggtagagagcaaagattgccagcttgctcacattggattgtttgctaatcaagatattgccgtaggagaagaactcgcctatgattaccgacaaaagcttgtagcaggcgatggctgcccatgccattgtggaactaccaattgccgaggccgtgtctattgattttgcaggaatacactaactgttcaatgctcggttgcagaactccagagatttcaacagttctgtaggcttgctgagcgatttagcattgcaattttcctacagcttgagtgcagggctaggatctcattgttaatgctacaaatagtgattgtgatataggactcaggcaagcattaggcaataacatagtgtcgattttagtcatggtaccatcatgtttaactgattatttgttagaagcagcctgaaatgaaactgattcaggctgctctgttcgtaggcgagaattctctctgtaaaattccttcattcatattttatggttcatgagcccc

SEQ ID NO: 7483 - DNA, 1095 bp, Zea mays
cagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggattcaagaaggatgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgctgatccttcggttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtggtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctgagttctacacctgcttgtcttgcttatgtgacggtgcagtattgtgcctttaatatcaacctaaacattgactggttcgtcactgtaacattctcgtttgattggtttcttactgatgccagaatatgcagc

SEQ ID NO: 7484 - DNA, 1598 bp, Zea mays
tgactggcgaggcaaaagcgcaaacgcgaccacagacagagcgcgcttcaaggcctttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttc

SEQ ID NO: 7485 - DNA, 1204 bp, Zea mays
ctggttcactggccaattcgttgcttcgtggggctttggagtttggagccaatcttgccccttaaagtgtcggtggcagcgttttgtgatcatcatgagctttgtgttccgagggagcaggaccgacatcgaggccggtggcttcccagggttcgctcccgagcgccgcgccatgcgaattcatgcagggagcaggccggtgaatagcaattccttggcttttcttctaactgttcttgttttgttcatggtactgaactcgcaccagatctctcccaatcttctgctttggcttgtcttgggagtcttcctaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatttgacgatttagattatgacactctgagagcattggatgctgacaatagcccacatgctccatctatgagtgaagaagaaataaattctcttcctgtcttcaaatataaagttcaggcacaacagaggcatccccctgcccgaaaaagtgatgggccatctcagctatcggtttcttcaactgggtccggcaatgaggaaaagcaggatggtttaaaagcagatggaaccagcaaaccttcagaggatgaactaacatgtagtgtttgcttagagcaagtcacggtgggtgatctgttgagaagcctaccatgcttgcatcagtttcacgtaaactgcatcgacccatggctgcgccaacagggtacatgcccaatctgcaagcaccaggtgagcgatgggtggcatgctacaggcaacggtgaagaggatgcttcttacatggtgtgagtagctgactaggagtaggccatagctaactaccagtagctgctaactgaatccgtggaacatagttttcgaggtgacgggttggactgatctagggatgtgatctaatccctttctatcctaacaaaaccgcgtgtggaaacagttgtccagtacggttcttttacaggtaacgctcatttcaatcattctctgtaacggggcgtttggatcccttcattttagaggaattggaattcactcaataaagtaacttatttagtttgg

SEQ ID NO: 7486 - DNA, 1350 bp, Zea mays
cacccacctctctctctctctctctctctctctctctctctctcttgttgggacctggagaagaggaaggaacagggagcaggggggaagaagaggttgctgcgacggctcaagcctcaaatttttggatccaggcagacaagcagagaaacaccagttggtcaagatgtcagctggtttccagctcggtgtgatcgggtcacttgcactctctgtcgcatcctcagttgccattgtcatctgcaacaaagctctcatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctgaggcttttcttgtagtttaggtctagtatgaactgcccttcgaatttaaaggacctggaaagccattcttttcattcttgagttcctttttaggaaacggagcttttaaaatttgtatagaatgcatattttgacattaaaattattatttgattgtattct

SEQ ID NO: 7487 - DNA, 1362 bp, Zea mays
gctgctgggaggagaggggaagcggcggcggggcgccatggaggcggagaagaaggcgccggcggtgtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctctctcgtcgccaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcggtggttgtcgtggccgccggtgtcgggatttgcaccgtcacggatgtcgaggtcaatgccaaggggttcatctgcgcttgcgtggcagtgttctgcacgtcgcttcaacagattacaattggttcctttcaaaagaagtacaacattgggtcatttgagctgctgagcaaaactgcaccaatccaggcaatttcactcattatactgggcccctttgtggactactatctaaatggacggtcattgttgaactaccctttttcgggaggggcaactttcttcatcttgctttcctgctccctggccgtcttctgcaacatgagccaatacctctgcatcggccggttctcagcgacctcgtttcaggtcctgggccacatgaagaccgtgtgtgtgctgatcctcggctggatcctgtttgactcagccctcaccgtgaagaacatcctcgggatgctgctcgccgtgatgggcatggtggtctacagctgggccatggaagcggagaagaaggcggcagcccctgtcccccggatcaagagcgaaatgctcgacggcgaggacgtacccctcaaggccagggtgagcggcgtgcccgcggtcgacctcgaggacggtgagatgaagagctagctgccgccgccgccgctgattcgttcattcttcttgttcttttgtaactgtgcgcgcgcgatcgctcgatccaaagttgcttgtccgtcagccctcagctatcgacactacactgttaattttggccccttgttggggagagtccagttcctaggtgacgacgaccacccccagttcggcgtagatcaaacacacactagcagaatgcagatttttaggatttttttcaggcggcggggtgatccattcattgtcatgttgacaagactcataatagaaatacaggtaac

SEQ ID NO: 7488 - DNA, 1463 bp, Zea mays
ccctttaaaacgcacaactccataaaccctagcggacaaagccacttgctcacaccagaaccctctccgcaatctccccgcctcgctcccgcctccacccaatggcgtctctccctaacggtggcggcgccgccgcctctggctcatgcggcgcgcgccctgtggacaaggaggtggacttcgccaactacttctgcacgtacgcctacctttaccaccagaaggagatgctctgcgaccgcgtccgcatggacgcgtaccactccgccgtcttccgcaacgcgccccacttccagggcaaggtggtccttgacgtgggcaccgggagcggcatccttgctatctggagcgcgcaggccggggccaggaaggtgtacgccgtcgaggcgactaacatggcggagcacgcgcgcgagcttgctcgcgccaacggcgtcacggatatcgttgaggtgatacagggcaccgtggaagacgttgaccttccggagaaagttgatgtcattatatcagagtggatgggctactttcttttgagagagtccatgtttgattccgtcatttgcgcacgtgaccgctggttgaagccagatggtgtgatgtatcctagccatgctcggatgtggctagcacccataagaactggtttgggtgacaagaagagggaagattttgatattgctatggatgactggagcctgtttgttcaggacactcaaacttattatggtgtcaacatgaatgctttgacaaaggcatatcgtgcagaacatgaaaaatactatttgaagtcttcaatatggaacaatcttcatccaaaccaagttatcggtcaacctgcagctatcaaggaaattgattgcttgacagccactgtcgatgagatccgagaagtcagagcacaagtcacattgccaatcagaatggaagctagattatcagcactggctggatggtttgatgttcattttcgaggtagtgctcaaaaccctggggtggaggaagttgaattaactacagcgccagatgagcatggtggaactcattggggtcagcaggtattcttgctgactccacctctgagtgtgactaaaggagacaacgttaacgtttccttctcgatggttcgctcgaaggaaaatcatcggcttatggatatggagttcacatatgaattgcacgagttatctggcaggaagcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattagtaatatattgtttgattgcccaattaacggggtgagccattgtttcatcacaacatcgatgtgttagcagataaccacatcgccgttttaagcaaacattgagtgcgg

SEQ ID NO: 7489 - DNA, 1106 bp, Zea mays
ccagtctaagccaccacccaggcccagctcacctctttcctctcttctcatgcccacgcgctcgcccatctcatagtccttccccattccgcctctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtatcgggagtcgttcgaggagtatatcacctccatggtactaccttcgctaagggagaaacatgatgagtttatgctgagggagctagtgcaaaggtggtcaaaccataaagtcatggttcgttggctctcgcgtttctttcattaccttgaccggtacttcatatcaaggaggtcacttaccccacttaaagaagttggtcttacttgcttccgagagttgatatatcaagagattaaagggcaagttaaagatgcggtgatagctctgatagacaaagaacgcgagggtgaacagattgaccggggtctgttgaagaatgtattggatatttttgttgaaattgggctgggtcaaatggagtgttatgagaatgactttgaagatttcttgctcaaggatactacagagtactactctgtcaaggctcaaagctggattcttgaggtgcgttatggtgatttgcgtgcttatgggtcctgccacagcaagggctgctcgcatttgtaaattggccgttaaaatagacaatcttgacctgcattagatgatatgatgatgatatgaggaataggagaggcactcaagtacttgtttgccatctatgccaatgttttacctatatgtctgtatcaatgtttcagttaactgagatgagattatgcttgggggttgctttgct

SEQ ID NO: 7490 - DNA, 976 bp, Zea mays
aactttcttctccgtcacctgactcacacctccactcacctccggtccaccaacctctgccggccatggcggctgcggcggcgcagaagctcctcgaggcgagcacgaagatcatcggcgtcgggcgcaactacatcgcccacgccgaggagctcggcaacccgatccccaaggagcccgtactattcctgaagccgacctcgtcgttcctccacgctggcgtggccaccgccgccgtcgagatcccggagccgctcgaatcgctacaccacgaggtcgagctcgccgtcttcatctcccggcgtgggcgtgacattcctgaagcgtccgccatggacttcgtcggaggctatgcacttgctttggacatgacagcaaggggccttcaatctgttgctaagtctgcaggccttccatggactttggctaaagggcaagacaccttcactccaattagtgcagtagttccaaaatcatctgtcactaatcccgacgatctagagctgtggctaaaggtagatgatgaactaaggcagaaaggatcgacaagtgacatgatattcaagatcccttttctgatcagctatatcagctccatcatgacattaatggagggtgatgtgatactaacaggtactcctgagggtgtgggtcctgtgcgagtaggtcagaagatcaaagctggtataactgacctaattgatgtcgagttcgatgttcagaggcgtaaccggtcattttccacatgattcaataagcaagaaagtaacggtcaaccgcttgaagattgctgctcgtgtcacgcgttcctcttgggtattcattcttccttgcgttgcagcgagattgcttcggcccatgagatgcgagtttagcctgtgcccactcatggcttaagcaaaatacctactggccaatgttgtatacttgtactggtgatatattactatgtaaaatagaaacaaaagttttgttt

SEQ ID NO: 7491 - DNA, 2307 bp, Zea mays
catcaccacaccccgtctccaccccgtacaaatccaaaagagggcgaggagggaaacagatcggctggcggcaatcggtagccggcttggctggcacgatgggcggcgaggccgagggcggggagcggcggctggggcgggtgctgagctttgggatcccggacacggcgctggggctagtgatggggtacgtggaggatccctgggaccgcgacgccatctcgctggtgtgccgacactggtgccgcgtcgacgcgctcagccgcaagcacgtcacggtcgccatggcctactccacaacacccgagcgcctgttccggcgcttcccgtgcctcgagtcactcaagctcaaagcgaagccccgcgcgtccatgttcaacctcatctccgacgactggggcgggtctgcgtcgccttggatccgacagctctcggccaccttccacttcctcaagaagctccacctgcgcaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaaatgatgagtggatccgtgagcttgctacgagcaattctgttcttgagacactgaatttctttctaacagatctcagggcatccccagagtatcttaccctccttgtgcgcaactgtcaacgattgaaaactctgaagattagtgaatgtttcatgcccgatctggtcagtttgttccgaactgcacaaacactacaagagttcgctggtggttcctttgaagagcagggtcaacctgtggcaagtagaaattatgagaactactattttcctccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctttagaggcagttggtacatgcagcaaaaatcttaatgacttccgccttgtcctccttgatagagaagcacatataaccgaattgccactggacaatggggttcgtgctttgcttagaggttgcaccaaactacggaggtttgcattttatgtgagacctggggccctatctgatgttggtcttggctatgttggagaatttagtaagagtattcgttatatgttgcttggtaatgttggtgaatctgataatggaatcatacaattatcaaaaggctgcccaagcttgcaaaaactggaggtgaggggttgtctctttagtgagcatgctttagctttggctgcactacagcttaagtcactgaggtatctgtgggtacaaggattcaggtcatctccaactggaactgatattatggcaatggtacgccccttctggaacattgagtatattgttccagatcaagatgaaccttgcccagagcataagagacagattctggcatactactcccttgctggcaggaggacagattgtcctccatcagtaactctgctttacccggcattttgagtgtagatacttgctttttgccagactgaatctcatggtactaagttccattggtcccactatctgtgaagtaaatggtccctgttcttccaattgatgaggacatgcagacgttccagtgcaaagaaccccaaaggtaagctttaagcaggacggccagctctgaactgaggctagctgagaacaatcatgaatacctgaaggcagcacttatgtcagcttggcctagctgtccagtatgggcatgtaagctttaccatcttttgtagttttggagaaacaattttgcaataactacccttgtttagtgtatattatcgattttcgttcatatgctgttgtattgttgtattgaacaattatgtcaattaattagtctacactctacagtctaacttgctgtgattcgatgaatagtgtttatatcacccac

SEQ ID NO: 7492 - DNA, 1577 bp, Zea mays
ggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaacgaagcagaccctcacgagggcgctctcctcgttgcgtcgacgattcagatcatacttgggttcagtggcctctggcgcaacgttgtcaaattactgagtccgctggcagctgttcctctggtatcactggtcgggttcgggctctacgagcttggctttccaggggtagcgaaatgcgtcgaagttggcctcccagaactgctcctgttggttgtgttttctcagtatctgcctcaggttctggacttcggcaagtccgtcttcagccggttcagcgttctcttcaccgtcgccatcgtgtggctgtacgcctacatcctcaccatcggcggcgcttacaagaactctccgcccaagacgcaggtgcattgccgcgttgatcggtcgggccttatttcaggagcaccttggataagtgttccctatccctttcagtggggtgctccgacgtttgacgccggagaagctttcgctatgatgatgacttcgttcattgctcttgtagagtcaactggcgccttcatcggtgcttcgagatatgcgagtgcaactatgattcctccatcgattatcagtcggggcgtgggatggcagggcattggtctgttgctcgattcatttttcgggacagcgaacgggacatcggtttcagtagagaatattggactgcttgcgttgacacgcattggcagccggagagtggtgcagatatctgcaggcttcatgattttcttctctgtccttggaaaatttggagctttgtttgcgtcgattccgctgcccgtatttgccggcatgtactgtctcttcttcgcatatgttggtggcgttggcctgagcctccttcagttctgcaacctaaacagctttaggaccaagttcatcatggggttcgctttcttcatgggcctatcggttcctcagtacttcaacgagtacacagccgttgcaagctatggtccggtgcacactggcgccagatggttcaatgacatgatcaacgtgccattcacgtcgaagccgttcgtcgctgggttggtagcctatatcctggacaacaccctccaggtaaaggagagcgcggtgcggaaggacaggggcaaccactggtgggagaagttcaggagcttcaagaaagacgcgaggagccaagagttctactcgctgccgttcaatctgaacaagttcttcccgtcggtctgatctcaaatggcgccgccgctgaatcaattctggaagcaacccttgttcatatgggcgttaatgaggaacataattctgctggtctggccagtggaagcttctgtgtctccattgttggtcaattttgtgtgttttcggacgagatgggagtaattgaactgtagaaattattacgattgaagtatatcgcgttctttttgtaatct

SEQ ID NO: 7493 - DNA, 1414 bp, Zea mays
gaacgctgctgtggccacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggctgcgctcgagaaggactacgaggaggtcggtgctgagtttgacgagggtgaggacggcgacgagggtgacgagtactagacgctctactggcgcggcgtcgtcgggcttgtgtgccactgctatcctgtgatctgccctgagtggctcctatcgtgttatgtttctgtcggttcttatctatctgtcgttgtgtggtttacaacttacgttgtaagactttattcccccgctttgctactgggttattaagtttggcgttattgttttcttgatctctgaaaaaaaaaaaaaaatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggtt

SEQ ID NO: 7494 - DNA, 1016 bp, Zea mays
gattagaaaggccgaagccgtctccgttcctcctcgacgcgtctcttccacagccgcaacctctatccctcgtctggtatcgtctcccacacccctctgccccaactcagaaaaaccctcgaaaagcggcggcggcgcgacattgcggaggtcgaggctccagctgctgcggttgcggcggcgacccctgaggtggcgacggtgaccgagggcggagccgctacggaggcgaagggtccgcacaagctgcaccgccagtggaccttctggtacgacatccagtccaagcccaaacccggcgctgcgtggggcacctccctcaaaaaggcgtacaccttcgacaccgtcgaggagttttggggcttgtatgatcatgttttccgtccaagcaagttgcctgggactgctgattttcacctattcaaggctggagtagagccaaaatgggaagacccagagtgtgcaaatggtggcaaatggactgtcccatgcaacagaaagccaacctttgagaccatgtggcttgaaacgttgatggctcttgttggggagcagtttgatgaaacagatgacatttgtggaattgttgctagtgtccgtccaagaggagataagcttgcattgtggactaggactgccagcaatgaagctgtccaggtaaacattggcaagaaatggaaggatgtcatcgactacaatgacaagatcatctacactttccatgacgactcgagaagggataagccaagcagaggtggacggtacaccgtgtaagttgcacacgaagaaggtcgttgttgttcggactggacagagggtgagagtggagttttgtgctgagatcggcaccagctttcatttaatacagcctcagcttacctgaggcaattttcgcacctgttatgatgttgttttgctctcagataggtttatgtagcacaagaaagatatgttggagacgttgacgattttgtatgcaactaaatttctatcttaatatgccccgattcaacagc

SEQ ID NO: 7495 - DNA, 1237 bp, Zea mays
caatcaaccagcaacactcttctcgtataacataatacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttggtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgcggctcgtgattccaccgccctggttggtggaccatactgggacgtgccacttggccggagagactcgctcggtgcaagcatccagggctccaacaatgacatcccagcccccaacaacacactccccactatcatcaccaagttcaagcgccagggcctcaatgttgttgatgttgtcgccctctcaggtggtcacaccattggtatgtctcggtgcactagtttccggcagaggctatacaaccagacaggcaatggcatggctgacagcacactggatgtatcctacgccgcaaagctgaggcagggatgcccccgctctggtggtgacaacaacctcttccccttggacttcatcacccctgccaagtttgacaatttttactacaagaacctcctggccggcaagggccttctaagctctgatgagattctgttaaccaagagcgctgagacagcggccctcgtgaaggcatatgctgctgatgtcaatctcttcttccagcactttgcacagtctatggtgaatatgggcaacatctcgccactgacagggtcacaaggtgagatcaggaagaactgcaggaggctcaacaatgaccactgagggcactgaagtcgcttgatgtgctgaattgttcgtgatgttggtggcgtattttgtttaaataagtaagcatggctgtgattttatcatattatcgatctttggggttttatttaacacattgtaaaatgtgtatctattaataactcaatgtataagatgtgttcattcttcggttgcc

SEQ ID NO: 7496 - DNA, 919 bp, Zea mays
ctctcgcccaccggcgaaaaaccgttcccctctgccgtttccgggtctcttagtgcaagcaaggaggccgttccacgctcctccagcgagctccgttctgaagcggcaagaaagatgattaatcttttcaaaataaagggtcaaaagaaagatgaggcagcaagtgctactggaaaggcccctgttaagaaacagtctgctggggagctccgtcttcataaagatattagtgagctcaacctgccgaagaccacatcaatttcttttcccaatggcaaggatgatctgatgaattttgagatcaccatccgacctgatgaaggatattacatgggaggcgctttcgttttcacctttcaagtgtccccatcttatcctcatgatcctccgaaggtcaaatgcaagaccaaggtgtaccatccaaatattgatttggaaggcaatgtctgtctgaacattctgcgtgaagattggaagcctgttctcaacatcaacaccgttatttatggcctgaatcttctttttacgcaaccaaacgacgaggatcctttgaaccacgaagctgcagctgtcctccgtggcaacccaaagatgtttgaggcaaatgtgaaaagagccatgaccggaggctacgtaggccaacactatttccaaagatgcttggcttgatgtgatggcttcaagccagcgggcccatgtatcagcaccagcgcgcccaggtttggaggatttttgtggatttagggcgcttctggaagcaaaggtcaaatcggtcgttgttgataatgtgatgtactccctcagttctttttatttttcatgttttagtataaaaatgaactaacaaacgacaaatattcgataacgaggtagtatctgtttgccctgtgacgtgtttaaaaccggtgaatttggggat

SEQ ID NO: 7497 - DNA, 1452 bp, Zea mays
cgcagacaaaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaaggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggagcaaagcttgtccgggatgcattccagcttgccaaagagaaagctccttgtattatatttattgatgagatagatgccattggcaccaaacgttttgatagtgaagttagcggtgatagagaagttcagcggacaatgttggaattattgaatcaactggatggattcagcagcgatgagagaataaaggtcatagctgcaactaaccgtgctgacatccttgaccctgctctgatgcgatctggacgtttggaccgaaagattgagttccctcacccatccgaagaagcaagagctagaatcttgcaaatccattcaaggaaaatgaatgtaaatcctgatgtcaactttgaagaattggctcgctcaactgatgacttcaacggagcacagctaaaggcagtttgtgtagaagctggtatgcttgccctacggcgggatgctacagaggtaactcacgaggatttcaatgaagggatcgtacaggtccaggcgaagaaaaagtcaagcttgaactactatgcttaagctgtttgtcaaaacatatggaccataaggtgtttgtaacactactgtatgaataatcgaagctatgtttttaatgc

SEQ ID NO: 7498 - DNA, 770 bp, Zea mays
cccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgctccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaatgtaccgtggttgtgaaccggtcaatgtgatctgaaataaaacattgcgtgccaagtttgtgtt

SEQ ID NO: 7499 - DNA, 703 bp, Zea mays
gcgccgcctgatcgaagtgaacaagcaaggaagagccatggcgagcgagcacgcggcggggggcgatgctaagcatcaccagaagcagagcctgatggacaaggcgaaggggttcgtcgcggagaagatcgcgcacatccccaagcccgaggccacgctggacggcgtgacgttcaagggcctgagccgggagtgcatcacgctgcacagcagcgtgaacgtgtccaacccctacgaccaccgcctccccatctgcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcgggctcaccgtcgacctccccatcgtcggcaacttcaccatcccgctctccacctctggcgagttcaagctccccaccctcaaggacttgttctgatctagtagtagctcgcttgccttgtgttctgtgcgggcgcgcaccagcgatctgtacgacgagcttttgcaaataaacgacgcagctcctctgttctatatatctcagtgaatgcctaagctaaggggatggatggtttaataaataaagagctggatttcattc

SEQ ID NO: 7500 - DNA, 1678 bp, Zea mays
caaaactcgcagcaacgaattgggcatattccccccacctgcaccccccacttttggcactttcccttccggccccctctcctcggcgcgatctaaatccggtccggcgatggacggcggggggcagcccccggacacggagatgacagacgccggcgcgggcggcggggggcagccttcgccaccgcagcagccggcgggcggggccgggatgatggagaacatccacgcgacgctcagccacggtggccgcttcatccagtacaacatcttcggcaacgtgttcgaggtcacctccaagtacaagccccccatcctccccatcggcaagggcgcctacggcatcgtctgctcggcgctcaactccgagacggcagagcaggtggccatcaagaagatcgccaacgccttcgacaacaagatcgatgccaagcgcacgctccgcgagatcaaactgctccgccacatggaccacgagaatattgttgcaataagagatatcatacctcctccattgagggaggcattcaatgatgtgtatattgcctatgaattgatggatactgatctgcatcaaattattcgttcaaatcaagctttgtcagaggagcactgtcagtattttctttatcaaattcttcgtggcttgaagtatatacattcagcaaatgttcttcaccgtgatttgaagcctagcaatcttcttttgaatgcaaactgtgacctcaagatatgtgattttgggcttgctcgcaccacctcagaaactgattttatgactgaatatgttgtcacaagatggtatagagcaccagagcttttattgaactcctctgaatatactgctgccattgatgtgtggtctgtgggctgtatatttatggaactgatggaccgaaaacccttgtttcctggaagagaccatgtccatcagctacgtctactaatggagctcattggaacaccgaatgaggctgatcttgattttgtaaatgaaaatgcaagaagatatatccgccaacttccctgtcatgctagacagtccttccctgaaaaatttccacatgtacaacctttagcaattgacctagtggaaaagatgctaacttttgatcctagacagagaataactgttgaaggcgcacttgcacacccttacttggcatcacttcatgacataagtgatgagccagtctgctcaatgcccttcagcttcgacttcgagcagcatgcattatctgaagaacagatgaaggatctgatctaccaagaggctcttgcattcaacccagattaccagtagccaaagttcggttccagccggtgattgcgttcattgacatggagatttttatcccacctgatgtcactgcaaaaagtcgccaactccgattgctagctgtaaataattgccttccccgaagacccccccattccttccttgattaaaaaaagcaggagacggtggccattcaagggtagaaaagagcgagcttgtgaaggtcaaatttctgcgcagctatggattcttgtgcttacaatatgttgtttttaatcaggttttcctttctttttcttcttaagtacttctcggtgttgtctgtaagagaggtagctcatgaacgatggctgcctgaattcagtggctgtcgtcaaagtgaacagttctagtcgactt

SEQ ID NO: 7501 - DNA, 1391 bp, Zea mays
cacaaagaagaaaaatggaagtaccaacactctgggtggtggtgaacaagaatctggagtggcttcaatgtcaaatgaggaatatttgcacactgatacccatggtttgcagatatcagaaactgttgttgaacctcaagtaggtagatctgagggagacttgttgcctacaagttctacagatgatctacatatatcaggggggagaacaaagcaatctgatgcaggtgaattacgcaaaggaaatagcatagatgatagcactccaacttatctagatatcacgataggacatttacctgaacgcaaaactgcatccaggatcacaacagagggttctggtgagtttattactgggaaaggaatgttagctggcacatcttctgtgaccatcagtgcaatggaagctggtcgcagtgaagatggagctgattcgatatatgatccttcaggtgctataactccttatcatgattctcaaacgcaaacagtaatgccacatgagaatacctcaactggtatccttggaccaccagcgttacctgtgggagtttctacaaggtttgaagaaaagaatatcatgcaagaggccccagaaattattaaaacaggagggaaggatacagaattgaaaaggagaaattttcaaagaaataaacaagtattgaaggatacatttgatgaatgggaggaagcataccagcgggatgctgagcagagaaaagctgatgagttattcatgagagaagctttacttgaggcccagagagctgcagatatttgggaggtacccgttggtgcagtgttagtacagaatggcgaaattattgctcgtggttgtaatcttgtcgaagatcatagggattcaactgcgcatgctgaaattgtttgtataagagaagcttctaacaaactcaagacatggcgcctagcggacacaacgctttatgtgacattggaaccttgtgccatgtgtgctggtgctattcttcaagctagaatcgatactgtggtatggggtgccccaaacaagcttctgggagccgatggcagctgggttaggctgttccctggggatggacaaacaagcactcttgattcaacaaaccagagccaggccgcagggcctgtccaccctttccatccgaagatagccatcaggcgtggtgtgctgtcggccgagtgctcagagataatgcagcagttcttccagctgaggaggaagaagaaaccacagtcaccaccgcaggcccaccgccatgggcaccatcatcctgtcaagttcttcagcaagatgcaccacatgttcggcacgatattctgtttataacttcgcctctctgttttattttagcttcctaaatttcgtattatggaagtgtgaaaaatgc

SEQ ID NO: 7502 - DNA, 2530 bp, Zea mays
tgcttcgctgttccctttccccgcccctacctggggcatctgcctctgaatcgcggcggctcccgaggcgccgcctggcgagcgtctaggcgccggtctacggcgacgatggaggtgtgatttggacgggagagagcgtggtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcaggctacttgaacttgtaggccttgagatggaccttccagttatcatgatgtctgctgattcaagaacggatattgtaatgaacggaattaagcatggagcatgtgactatttaataaaacctgtcagaatggaggagctgaaaaacatctggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaaaccaagagttgtttggtcagttgagcttcatcaacaatttgtgaatgcagtcaatcacctcgggatagacaaagctgtcccaaagaaaattttggaattgatgaatgtcccaggcttaaccagggaaaatgttgccagccatttgcagaaattcagactctacctgaagagaattgctcagcatcatgcaggaatacctcatccatttgttgcgcctgtatctagtgctaacgttgctccgttaggaggactggaattccaagctttggctgcttctggtcagatccctcctcaagctctggctgctttgcaggatgaactccttggtcgacctacaagcagtttggcgttgcctggaagggaccagtcatctttgcgagtggctgcaatcaaaggaaacaagcaccatgaagaaagagaaatagcatttggtcaacccatatacaagtgtcagaataatgcatatggtgcattccctcaaaacagcccagcagttggaggattgcaaccttttgcagcttggcccaataacaaagttggtatgactgattcaacaagcacattgggaaatgtgggcaattctcaaaatagcaatatgctattgcatgaattgcagcaacagccagacaccttgctgttaggaacccttcacaatattgatgccaaaccttctggtgtagttatgccatctcagtcgttaaatacattcccggctagtgagggtatctcacctaatcaaaatcccttgattataccatctcaacccccaagttttgtgtcatcaattcctccatccatgaaacatgaatctcttcttggattaccttcaacgtcaaccagtctgttgggcgggcttgatatggttaatcaagcttcaacaagtcaggctttgattagtagccatggaacaaatcttcctggtctcatgaaccgtagctcaaatgcaatcccttcaccaggaattagtaattttcaaagtggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaacaacttgagccacagcattggaaacagtggagacatagtgaaccacgacatatttggatttagtggacatatgtgaaactttcttgaatttcgttgatcagtgagcactggaaacaaatctagtggtttgatgaatggttgctagtaatttcgtttcttttttttttcttctgtaattggtttataaagggaataatctatgtggcagcatgtggaatcttactttatagaagtttgttcagttcaaaggacttaaaattggtcagtcccttgtcatatagcttcttttctttgttctctttttctgtaattaccaattgtagcattatttttatgaccgtcgtaattcagcctagtcgatttattcccggcc

SEQ ID NO: 7503 - DNA, 1570 bp, Zea mays
tcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttttgtgct

SEQ ID NO: 7504 - DNA, 1160 bp, Zea mays
tcctccaccaccattcatcagaaagcgaagcacaagcctctgatgccaagccaaagcacacacacctcctccagcctttcttcctctacagccccaattcttccctgcagctctgctgctgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggatagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaataggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcagcagcagcgatagcataaacaaccgcaagagaaagggtgcaggcaccgaagaaatcttgccccagctggcaaacagatcaaggcacagttaactgagaactgactagtacagctaaaaccttttctttttcactttactttggcctactgatttgtaacgtagatgttagccctggatttgcaaaacggaacggaatctgtaaactgatactgcttgagtcgaatcgatcgaagtgattctgcaccagatctccctatttcatttatcagaatcgaaagccagctgacagagtcacagtaacagcccgttggacatagcagcaggtgccgaagccaagaacatctgaaactgaccgtcggataacctacgatgggagtagccttttactgcttctaagctttagcctggatacaagttgtcactacagtagtcagtagggcagtaacttggtgcatctccaagagttttcaaaacacactgtcaatctagaaatttttggtg

SEQ ID NO: 7505 - DNA, 1023 bp, Zea mays
gcggcggcgcgcagatgctgctcttcggcggcggaggcagcgccaacagcaacggcttcttccgaggtgttccgatggcggtcctgggcatggacgacgcgacgcgcgtgggcaagcggcccttcttcacgacacacgaggagctcctagaggaggagtactacgacgagcaggcgccggagaagaagcgccgactgacggcggagcaggtgcagctgctagagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgccttaaggctgcttacgacgcactcgccgccgaccaccagggcctcctggccgacaacgataacctccgggcacaggtgatctccctgacggagaagctgcaaggcaaggagacatccccgtcagcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcaacccttttctgcagcatataattaccgtgttaattatgtgccgtccgatgtttttaagtgctcatgttttaagtttgtgttttttttgaagtttttgtatgttcatatatataataatgtgcttcgaacatgacactcgaaaagttgaataattggacatgtcgacctgctgtgcactagcagctggcatgttttgttt

SEQ ID NO: 7506 - DNA, 1320 bp, Zea mays
attgtgcttatcatgcgacctaatgttcattcagctaatgcactgtctcgacgtcatacaaggacccttctttgtgatcgttgtggttcacagcctgcatcagtccgatgtcttgaggacaacgcatcactttgccaaaactgtgactggaatgggcatgatgcagaatcaggggcttctggacataaaaggcaagccataaactgctactcagggtgcccatcatctgcagagctttcgagaatctggtcatttattactgatatcccgactgtagcagctgagcccgactatgaggatggactaagcatgatgacaattgatggcagtgatgttactaatcgtcacgatacttcagatgataaaagattgttggaaatagctaacacaacactcatgagcgatccaccttcagccgacaagcttaaatctccgacaggctcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctatttggtacctctcacattcgaacagaggaactctttgatgacgctggaattgacggttacttcgaattgaaagagacaccacctttttatttcaacgagcccaaagctatgcagatagaatgtggcaacgtggtatcagctgattgtgcgatgtcaaacccaggggcaagggctgattccagcctttgtattcccgtcaggcaggtcagatctagtatatcccactccttatctggtctgactggtgagagcagcgctggagatcaccacgactgtggggtgtcaccgatgctcctcatgggtgagccaccctggcattctcctggtggtccagaaggctcagtcgctggaggcagcagagatagcgctctcacacggtacaaggagaagaagaagaggagaaagtttgacaagaagatcagatatgcttctcgcaaggctagggcggacgtgaggaagcgggtcaagggacggttcataaaggccggtgaagcgtacgactatgatccgctaagccagactagaagctactgagccttgggagtgtgactgttgttgtcgtccagtgtcagcctcgcaatctccagccgctcgtcggttgcaggctgcgctacaggcaagatcactggagagcacaacgatcgcattgcatcagagcctgcaactgaaaaacgttaagaagagataccaagtgttaggatg

SEQ ID NO: 7507 - DNA, 1829 bp, Zea mays
cccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 7508 - DNA, 1106 bp, Zea mays
ccgcagttccccgaccacaccgttcctccgagcccaggagcagccccgcgccaggaggaagtttgttcttttaacaatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagcttttaaagtcatcgcattc

SEQ ID NO: 7509 - DNA, 806 bp, Zea mays
ggggaacacacagaacatactcccgctgaagcgctgagaagtagataagaataatatggggttcagtgaggcacaggaagagctcgtcctccgttcatggaaagccatgaagagcgactccgagtcgactgctcttaagttcttcctcaggatctttgagatcgcgccgggtgccaagcagatgttctccttcctgcgcgacgccggcgacgcgccgctggagaaacaccccaagctcaaggcccacgccgtcaccgtcttcgttatggcatgcgagtcggcgacgcagctgagaagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaagaggcctacgaccagctggccgccgtcatcaaggaggagatgaagaacgccgccgccgccgaggagcagacgaagaacgccgccaccgccgaggaggagattaagaacgccgccgccgccgaggaggagacgacgaacgccgccgcggctgttgatggttcctagctcccactacgctcctctgctagcgaccgtggcacgcgcaccgctgcgttgatgggtgcttttggactgctgctggcctgatacctacctacgaagctgttgctaatgctgctgcatttttgtttgtcgaccgcatcattgtgatgataaataaaatgttcagaaaatgcccgtt

SEQ ID NO: 7510 - DNA, 864 bp, Zea mays
tttttaccacattagttgcctggcattcccagtgcatcaaacttgtaacacaaacttggcacgcaatgttttatttcagatcacattgaccggttcacaaccacggtacattagaaaacagggcacgaaggtagaaactcaaacaaatgccacataagttcaggcagacttaactctggtgtaacacacagagcgctaaattatgactcttcagccagagccaacagataatactcaaacaaaactctggtttccatggaagcaggcaaggcatccaagctcaactgctcaagcctcgtagatccagggatgaaggttgctcttccactgtgccacaccttcagggaaccagagagcgatctccttcttcccgttctccacggagtcgcttccatggatgacattcctgccgacttccacggcgtagtccccacgaatggtaccgggggctgcctcccaaggcctggtggccccaatgatcctgcggccagtcaacacgacgtccttcccctcccacaccatcgccaccacggggccggaaatgatgtactccaccaacccggggaagaaaggcttgtcggaaaggtcagcgtagtgctgctgcgcgaaggacctctccacgttcatgaacttcatccccttgaggtagaaccctttcttctcgaagcgactgatgatgtccccgatcaggccccgctggacgccgtcgggcttgatcatgatgaaggtctgctccatcgttccttccaacaaagggcgacgcgaatcggcgggggcgcaggggtgaggctgtgggagcgcagaccggagggaggggcgatggacgggtgggggaggagaggaggagaggcgcggacgcgtggg

SEQ ID NO: 7511 - DNA, 831 bp, Zea mays
gggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccctgtagctagctgctcctgcttgtgtcct

SEQ ID NO: 7512 - DNA, 714 bp, Zea mays
gtgcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttctggagctggctgggaacgctagcaaggatctgaaggtgaagcgtatcacccctcgccacctacagttggccattcgcggagacgaggagctggacaccctcatcaagggcaccatcgcaggtggaggtgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacattgtgtttgtgttgagttgttaacttcaagggtgcaaacctggataattatttagttattatatgactatctggtattcggttt

SEQ ID NO: 7513 - DNA, 739 bp, Zea mays
ccgcagctgtcgatccaattgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttactt

SEQ ID NO: 7514 - DNA, 1191 bp, Zea mays
cagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggctacctggatgcgttaataattgctttggtttctgcccagcgcgcgaacgtgttagcgtgtaatctctattttgcactatccagcgactaataaaaagaaacggatatatatatatatatatatcaattatcatttggatgttggtactgtgg

SEQ ID NO: 7515 - DNA, 693 bp, Zea mays
ctcggccgcagaagcgaaacagcctctggccgctgcccgaccccgacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttccctcagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttc

SEQ ID NO: 7516 - DNA, 736 bp, Zea mays
cagctgtcgatccaattgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttactt

SEQ ID NO: 7517 - DNA, 1381 bp, Zea mays
gaaaggagaggcccgcgactgtagtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaagtgatacttctcccttttctat

SEQ ID NO: 7518 - DNA, 1236 bp, Zea mays
gcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccatagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatatgcgcccaataagagcggcgtatggatatatgttgtcactatggaccattacttgttgtatgcactgtatatctatggactgttgtggtgttgtattagttcatgaaccatgaagctttgaagtaaaaatcccatgcatgtt

SEQ ID NO: 7519 - DNA, 1882 bp, Zea mays
gtgctcggtgcccgtgcccgcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggccaacatcgccatgctcatcgtcgggaggatgctgctcggcctggggctcggcttctccggccaggccacgccggtgtacctcgccgaggtgtcgcccccgcgctggcgcggcggcttcatctcggccttccccctcttcatcagcgtcgggtacctggtggccaacctcatcaactacggcacctcgcggatcccgggctggggctggcgcctctcgctcggcctcgcctccgtcccggccgccgtcatggtggtcggcgccgcgttcatcccggacacccccagcagcctcgtcctgcgcgggaagcacgacgacgcccgcgccgcgctccagcgggtgcgcggcaagggcgtggacatcggccccgagttcgcggacatcctcgccgcggcggagaacgaccgccggaacgaggagggcgcgttccgccggatcctgcgccgggagtaccggccctacctggtgatggccgtggcgttcccggtgttcctcaacctcacaggggtggccgtcaccgccttcttctcgccgatactgttccggaccgtcggcttcgagagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgacggtgctggtggtggcgctgatcttctcggcgagcttcagctggtcgtggggcgcgctgtactggaccatccccggcgagatataccccgtggaggtgcggtcggcggggcagggcgcggccgtggcgctcaacctggggctcaacttcttgcaggcgcagttcttcctggccatgctgtgctgcttcaagtacggcaccttcctcttctacgcgtcgtggctggttgtcatgaccgccttcgccgtggcgttcgtgccggagaccaagggcgtgccgctcgagtccatggctcacgtcttcgcgcgccactggtactggggcaggttcgtcaaggaccaccagaagttgggcgaagagtccacctagctaagctaataattcggaatcagcgaacgacgtaccctactaccagtagcagattattgataagggagtcaaacacatattgcgtgtgtgtgtcttttaaagtgttcgtttagaatggcttgagaagctcatccgtgtagtaaatttggagacttcgaaatataataaatatgttcgtagttggcaagct

SEQ ID NO: 7520 - DNA, 2033 bp, Zea mays
ccggcttgagcaataattgacttgacctcacttcccctgtggggaggcttttcttccgatcgatcatagtatccgctgcggtgtgactgcctgccccaccccattgcgcctgcgcctcgcttcatccggtgcgctgcccacctcactcccgtcgtcctcgttctcgtcgcggagcggtgtggaggcgcgcgctcctggaaggcacggggcaagagcggaggtgagtgagcccgagccccgtggattgctggttcggtggtcggaactcgtggagtagcaagagcggcggcggttacgacatctcacgccagcagtttgtcctcatctaccacccacctcccctgatcccctccccagtacccacttctctcatatcccctcccgcatcatctctttttttttctctcctcttagcgaggacgccgaattcgcgattggcttaggcggtgtgtgtggatcaaatcgagtctggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtattctaagatcggtgatgactaccgttctttgagccaggtgactgaagctttggcacaggcaggccttgaatcttcaaatcttattgtaggcattgattttacaaagagcaatgaatggacaggtaaaatttccttcaatcgccgctgcctgcatgatattggaaacactccaaacccatatgagcaagctatatctattattggaaggacactttcagcatttgatgaagataatttaattccctgcttcggatttggtgacgcgtcaactcatgatcaggaggtatttagcttttacccagagaaccgcccatgcaatggatttgaagaggcgctagacagatacagagaaatcgttccaactcttcgattagcaggacctacatcttttgcgccgatgattgagacagcaattggaattgttgacagcactggtggtcaatatcatgttcttctgataatagcagatggacaggttacccgaagtgtcgatacacaatctggacagttgagtccacaggagcgggctactattgatgcaatagtaagagcaagccagttccccctgtcaattgttcttgtcggggttggtgatggaccatgggacatgatgcaccagtttgatgacaatatacctgctcggtcatttgacaatttccagtttgtgaatttcacggaaattatgtcgaagagcatagcagctgacagaaaggaggcagaatttgcattgtcagcgctgatggaaatccctacacagtacaaagcaacaattgatctccaactcttaggccgtcgccaaagaataaccccaagaattgctctgccaccaccaacaaggaccgcgtattcgcggtccagtagctttagccaacagtctggtgtttattcgcgatcaagtagctttgaccaacaaacaagtggcgcctctcagcaacgttctgagagcttgaaacagcagaagaaacctgcagccacgaagagacctgacacttatgcttcagaaagagctttagaggacagaattctgtgccccatctgcatgtataaatccaaggaccttgcatttggatgtggacatcagacttgctacgaatgcgggagaaatttggagcgctgccctctgtgccagcagaacataaccacgaggatcaggctctactgatttgatcaggctatggattagaaagtgttggaacaacagactcccgggcaagatgttcagaaccagctttgttggtaccgtgcttcattttgtaattggtgtcacttttctctgtagttatgccaaaggaaagcgcaccagaaaataatgtacatatttatcttccagt

SEQ ID NO: 7521 - DNA, 1287 bp, Zea mays
ccggcactcgcctcccttttccctttccgcgccccatcaccattgccacaaatagcaaccaaggcagtaagcctagccaagccaaccgacggcggcgagagtatatatacacacacacctgacgcctctgctgctgctgggatcaacgcggcagcttagtgacgacgacgactcttctgtctctgcgttgattaatggacagtaacagatccatggcgacgagcggcgtggctccgttcgtggccaagacgtaccgcatggtggatgacccggcgaccgacggcgtggtcgcgtggggcagggacaacaacagcttcgtcgtggccgaccccttcgccttctcgcagacgctcctgcccgcgcacttcaagcactccaacttctccagcttcgtgcgccagctcaacacctacggcttccggaaggtcgatccggaccggtgggagttcgcgcacgtgtccttccttcgcggccagacgcatctcctgggccagatcgtccgccggagcagcggcggcaagcgcaaggacgacggcaacggcgccggcgccggctccgccgacgacgaggacgcggtggccatggaggtggtccggctgaggcgggagcagcgggccatcgaggagcaggtggccgcgatgtggcgccgcgtgcaggagacggagcgccggcccaagcagatgctcgcgttcctcgtcaaggtcgcgggcgacccgcaggtgctgcgccgcctcgtctccggcgccgggggcgacgccgtgttcgccgccgcggagccggaggacggcgcgagcatcaagagggcgcggctgcttctcgatgccggaagcggcggcgacggcgccgtcgacttcagcgggctctatagcacaaccgccggaagcgaagacgacggcgtcgggttcggcagcgattacctgcagccgccaccgccgtacgtgttccccgtcaacagcggcggctactgactgatggcggtctggtagtccagcatctatccgagcgatgtggcgtgcttcgtcgtcgttagttgcccctcccgagtgacgtgttggactgaagtggcaacggcgccgacggacggtgagcaaccaacccaagataattagctaggaggtggtacaaagtgtaaagcctttggtttaggcaggtctgcggtgatctttaatttgcttgttgcaatgttttccttccctaccttgtcaagtgattgctacggatcagcggcggcaaaagccgttagctgcagctagtttgccgctgctcttcatacagctgcacgccgtt

SEQ ID NO: 7522 - DNA, 1798 bp, Zea mays
gcccacggctggaggtgctcacagcgagcggagcggaggcgagggattcggccgcgcgcatggcgacgcctctctgaccgaagctgctccacccacttggccaggcgcgccgccctctcccggtcctccccacccccatcctcctcacggcacgggactcccctcccccacctcctcttcctcccctcccgcccacggctggaggtgctcacagcgagcggagcggaggcgagggattcggccgcgcgcatggcgacgcctctctgaccgaagctgctccacccacttggccaggcgcgccgtcctctcctctcccctccccttatcctctcgttacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggacatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggacacttccgcttgtgtaaatatgcgcccaataagagcggcgtatggatatatgttgtcactatggaccattacttgttgtatgcactgtatatctatggactgttgtggtgttgtattagttcatgaaccatgaagctttgaagtaaaaatcccatgcatgttaagttt

SEQ ID NO: 7523 - DNA, 1808 bp, Zea mays
caccgcactagcctagcctccccccgccgctcggccgaatagaatcgattccccctcctccgtcgctgtccggccgaccgcggagagcggagtcgatcgggggcgacaacgatggtggttagcgtggccgcgaccgggcccggcacggacgccgagccggtgagctccaccttcttcgcgtcccgctacgtccgcgacccactcccacggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagaccgctataggggtcggaacagtgggatcctcggaagcgatcatgcttgcaggtctagcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgcctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacagcgtcgtggccaagaaaagcgtgctggagatcgagcgggaggtcgccgcgcgctggaggaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgt

SEQ ID NO: 7524 - DNA, 1400 bp, Zea mays
cgagattcgagagaaatggcgatggcgacgccagctgccaaacaatcacttctcaccgtccaaccgtgcacaatgaattgaagcgccacgcggttccaataatctattgccacgggcaggtgcgtcgcgtcgattcctggtcttcgagaggagcggaggaggagggcggcgagtgcggaggagaggcgagttcagctgtagcgtttcgcttcttgcccgtggcggcggcggtgccacctcgaacgctgctccctgttctggggcttactgcggatcctgatctgagcatcattcagagaggaagaaatatgtttaggagaaagcatggctctgatttcaactcagatgatgctgagcaaagagaagcaaagattagtgaactgaaagctgctcttgggactttgtctgcccgtggcgagaagtactgcagtgaagcatgcttgagaagatatctggaagcccgtaactggaatgttgctaagtcgagaaaaatgttggaagaaagtctcaagtggagggcagcttacaagccagaggatattcgttggcctgatgtttctgttgaagcggaaacaggtaaaatgtacagggcaagtttccgagacagggagggcagaactgttgttgtcatgaaacctacaaaacaaaatacttcatcccatgaagggcagatacggttcctagtatatactttggagaatgcaatcttcagcctgcctgaaggccaagaaaaaatggtatggctgattgatttcacaggatggacagtgtcccatgcttcgccgataaagacttgtagagaaactgcaaatatactgcaaaatcattttcctgaaaggctggccattggatttctatttaatccccccaaagtatttgaagctttttataaggtcatcaagattttcctcgatccaaaatcagtcgagaaggtgaacttcgtgtacgagaaggatgaggagagcatgaaggtcatgtacaaatacatcgatccggaagtccttcctgtagagtttggggggaagagcaatgtggtgtacaaccacgaggagtactccgagttaatgagacaagatgacatcaaaacagcaagcttttgggcggttgatgcgaaaactaaccatgctaaccctgccatcaatgggaccttggttcctgaggttgcgccacagtcgtcgctggctgctaaagctagttgaagagtatctgcattctctgagaaaattgagaagccgaggactaatggaaccttgagagaaacatatgaaataagaaacatggtatactcgttcatcctcaagagttgtttaagtactggaagtttattcagcacacaataagctactagagaatgtcaccatgtgtgatttgatgcccaaaagagatggtttacaaggtag

SEQ ID NO: 7525 - DNA, 1123 bp, Zea mays
acagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggattcaagaaggatgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgctgatccttcggttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtggtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctgagttct

SEQ ID NO: 7526 - DNA, 955 bp, Zea mays
cctcacaacctcacccggctccatccacgcggctccaacgccagccacagcacgagccatggactcgcgcgtcgtggacggcgcaggtgggggtgccgacgcctccttgccggccgatccgccgagccccgtgcccgatccggccgcgggcgggatggatgcgcgcctcccatcggacctgcttcgtgcagtgctgcaaaggctgccgccgatcgacctcgcgcggtccgcctgcgtctgccgagcgtggcgcgcggttgcctccgaccgcgccgtggtcgaggccgccttctgtgcgccctggggagtgcggcgcgtcgtcggagagccggcgacgggggccttctggcgggccgcctcccttgggagatttgcgctgtcgcatgcgatccgccgcggggataccgtccccggtgtcgctctcaagtactccgtgcaggtgaccgatatcaaacgattcaacaacatgatgagtgaccatggcatctattcgagggagaggcttctggttccgatcagcaacccagaaatccttcttggcagcacctgctacatcgagatggaccataacgctaagagagaggttgcaatcttttaccccgagggacgcccaggtggcaaaactgactctgtggcaagcattgtctctgcggagaggagaaacaaaaggattctcgagtcggtgaggcggagcctgcacgtcgatgatggcactgctgcgtactacttatctgttactgagggtgatccgagggctgccatgacggagtactccgaggacctgaggtgggagcagcaacgcgcaggtcggtagattcatatatattccaatgacatatgttaagatcatggtgcttgatccttatcatttggtgtatatattgtacaatctggatggttgtaagtataaatacaaactttggtctaatgaatatagatgcatgtacgtgataat

SEQ ID NO: 7527 - DNA, 1744 bp, Zea mays
cgatcgtacacgatatgcggacaacgccgcacccttctatctaggccagactagaaggtagaagaagcaacgacggtcaagggcctagctatttgttaactctggcccctcacctgctccccttctgtccagcccacgggagggcgactagggttaggggcgaccggaggtcgccgcgcctgcccaaatccacccatcccttccgttcaagccgccggagctcccaggccgctggtgtcgaagccggcgtcccttccttacaggcccgcctcctctctgtccgttctgtcttggtcgacgaagctcaagaccacagtgtcaggaagctctccaatcttccagccaaacacaattcatcagtcagatacacttttaccaaggaatttttcagaatcactccacgagaggttcagctctcgaagctagagaaccagagctctaccaaacaggccaggacgtctctcaaatccccagttcagtaactggctaactgtaggagaaggagagagatggagaacggcggcgctaaacgcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgacgtgaggaaggagataaacttctgcaagaaggtcggtgttcctgtcctaggtgttgtggagaacatgagtggcctgaggcagccgctttcagacctcagattcattaagtcagatgaggcgggcgagacagatgcgacagaatgggccctgaactacatcaaggagaaagcccctgagcttctgtcggtcgtggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcggaacatcgtgaagaagctgatcaaggccgagggagaaaatagtgttggcctgctggggaatctggtagtgagaaatgagatgaaatgacagatgccagagttctcgttaccaatatatatatatgttacggcgttacacactgaatctgtattagtgctagtgttggatctgtaagtttttgttcgtgaataatcagtgggtgcacagactattaagtggac

SEQ ID NO: 7528 - DNA, 3080 bp, Zea mays
gcgaagcaaatccattccacaagcacctggtgggatcatctcatcatcagaaaccaagagagagattccgtgcccgcttgtagattgtgaggactgaggaccgagaagcagccatgaatccggacaacttcacccacaagacgaacgaggcgatcgtgggggcgcacgagattgcggtggaggccggccacgcgcagctcacgccgctgcacctggccgcagtgctggctgcggacaagggcggcatcctgcggcaggccatcacgggggcgtcggggggcgacggagcggccggggactcgttcgagcgcgtgctgaacaactcgctcaagaagctgccgtcgcagtccccgccgccggactccgtcccggcgtccacggcgctgatcaaggtcatccgccgggcgcagtccgcgcagaagaaacgcggggactcgcacctcgccgtcgaccagctgctgctcggcctgctcgaggattcgcagatctccgactgcctcaaggaggccggcgtgtccgcggcgcgggtgcgcgccgagcttgagaagctccgcggcggggaggggcgccgcgtggagtctgcctcgggggacaccaacttccaggctctcaagacatacggccgggacctcgtcgagcaggccgggaagctggaccccgtcatcggccgcgacgaggagatccgccgcgtggtgcgcatcctctcgcgccgcaccaagaacaaccccgtcctcatcggcgagcccggcgttggcaagacggccgtcgtggagggcctcgcgcagcgcatcgttcgcggcgacgtgcccagtaacctcctcgacgtccgcctcatcgcgctcgacatgggcgcgctcgtcgcgggcgccaagtaccgcggcgagttcgaggagcggctcaaggccgtgctcaaggaggtggaggaggccgaggggaaggtcattctcttcattgacgagatacacctcgtcctgggcgcgggcaggacggagggttccatggacgcggccaacctgttcaagccaatgctggcgaggggacagctcaggtgcatcggcgccaccacgctggaggagtaccgcaagtacgtggagaaggacgccgcgttcgagcggcggttccagcaggtgttcgtcgcggagccgagcgtgcccgacaccgtcagcattctgaggggactcaaggagaagtacgaggggcaccatggcgtgaggatccaggaccgcgccctcgtggtcgcggcacagctctccgcgaggtacatcatgggtcggcacctgcctgataaagccatagacctggtggacgaggcctgcgccaatgtgagggtgcagctcgacagccagccggaggagattgataacctggagaggaagagaatccagcttgaggtcgagctccacgcgctcgagaaggagaaggacaaggccagcaaagcccggctgattgaggtcaggaaggaattggacgatctgagggacaagctgcagcccctgaccatgaagtacaggaaggagaaggagagaatcgatgagatcaggaagctgaagcagcgccgcgaggagctccagttcaccctgcaggaggccgagcgccggatggacctggcccgtgtggccgacctcaagtacggcgccctccaggaaatcgacgccgcgatctccaagctggagagcgaaacaggggagaacctgatgctcaccgaaaccgtcggccctgaacaaattgcagaggtggtgagccgttggacgggtattccagtgacccggcttggccagaacgacaaggagaggctggtcggcctggctgacaggcttcaccagagggtggtcggccagacagaggctgtgagcgccgtcgcagaggcggtgctgaggtcgagggccggtcttggcaggccacaacagcccactggctcgttcctgttcctgggtccgactggcgtggggaaaactgagctagccaaggccctagccgaacagctgttcgacgacgagaaccttcttgtccgcatcgacatgtcggagtacatggagcagcactcggttgctcgcctcatcggagcaccgcctggctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacactgtgatcatcatgacatcgaacctcggcgccgagcacctcctcgctgggatggtgggcaagaactccatgaaggtcgctcgcgatctggtcatgcaggaggtgaggaggcacttccgccctgagctgctgaaccgtctcgacgagatcgtgatcttcgatcctctgtcccacgagcagctgaggaaggtcgctcgccttcagatgaaggatgtggccgtccgtcttgccgaaaggggcatcgctctggctgtgaccgacgccgcattggacatcatcttgtctctctcttacgatccggtgtatggcgcgcggccaatcaggaggtggatcgagaagagggtggtgacgcagctgtcgaagatgctgatccaggaggagatcgacgagaactgcacggtctacatcgacgccgcgcccggcaaggacgagctggtctacagggtggaccggagcggcggtctggtgaacgctgagacggggatgaagtcggacatcctgatccaggtccccaacagctccaccaggagcgacgctgcgcaggccgtcaagaagatgaggatcatggaggaggacgaggacggcatggacgaggagtaaaaggcgggccggaggacgcggagctgcgcccaggccgcaggtctggcgccggcatcatcgagtgtcttttgaataagcgtgtagataagcccgtgaatatgcagacgaggttgagatgatgttcttgtaacgctgctgtttgtcaagcatggacgaatggtctctcatatagtatcaaagtgacaagtctctcaatcgatgtcttgatgtcattatttttatctccct

SEQ ID NO: 7529 - DNA, 1211 bp, Zea mays
aagacgtcaaaggggattccaccggcgggaagcgattgcgagcatcggagtcatttcaaagtggcgtaggaagcaaagtgaagctatgcaccaattttttcagtacttatggttgtccctttggtgagggctgccattttgtccattacttccctggtgactaccgggccgtttcagaaatgaccaacctgggtggcgcaacaatcgcacctcctggaggaatgatgatggatgggccacctacacccatcgtgaagactcgcttgtgcaacaagtacaacactgcagagggatgcaaatggggggacagatgccactttgcacatggtgaaagtgagcttggcaagtctatgatggacaactatatgccaccccccatcggaccaccaccaaccggttattttgcacctccacctatggcacctccacctatggcgcctccacccatggcacctccacctatggcacctctacctatggcgcctccacccatggcacctccacctatggcgcctccacccatggcacctccacctatggcgcctctacctatggcgcctccacctatggcacctccacctatggcacctccacccatggcgcctccacccatggcacctctacctatggcgcctccacccatggcacctccacctatggccaaccctggtttggccactccagctagcttcggcgcttatgccacggccaagatcagtgtcgatgcgtcccttgcaggtggcatcattgggaagggtggagctaacataaagcaaatatcttccgtcacaggggccaaggtggtcattcaggaggaccgccatgaatcagacaccagcttgaaaaacattgagtttgagggcacctttgatcagatcaggaacgctagtgctatggtcatcgagctgattgttagcatcagtggcataggaagcaacttcaagaccaagatgtgtgagaacttcgcaaaagggtcatgctcttatggcggcaaatgccactttgcccatggtgagagtgagctgcgcaagcctgccgctgcttgagatccatgccctgtttcttacctcatagtcattagtcaatgtaactcaaaacttggcctctgatgatggatttgttggcttctttaggtctacgctaatgaattgctggcttcaggcctactactaaatttgctgacttctttagtccttcgctgttggccaact

SEQ ID NO: 7530 - DNA, 830 bp, Zea mays
ggtgggttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7531 - DNA, 1875 bp, Zea mays
agctacctctccgatccgaggcctgagcgagcgagctgaggactgcagcctatataatatctagactatagtacaccacaacgacgaggcacatatatatacacgcggcggcggccagatccatcttggtatacacgtaatatatatacacgcacgatgggcagcgccggcggcggtggcgagagcaagctggagagcccgctgctgggcgcgtcgtcgacgggccacggcgaggcggtgatcttctcgggccacctcggcacgctcgagctcgccgccgcctcgctcggcaacaccggcatccaggtcttcgcctacggcctcatgctgggcatggggagcgcggtggagacgctgtgcgggcaggcgtacggggcgcacaagtacgacatgctgggcatctacctgcagcgctccaccgtcctgctgatggccacgggtgtgccgctggcggcgctgtacgccttctcccgccccgtcctgctcctgctgggggagtcccccgagatcgcgtcggccgccgccgtcttcgtgtacggcctggtcccgcagatcttcgcctacgccgccaacttccccatccagaagttcatgcaggcgcagagcatcatggggcccagcgcctacatctccgccgccgcgctcgcagcccacctcgccctcagctacctcgtcgtctaccgcctcggcctcggcctcctcggcgcctcgctcacgctcagcgccagctggtgggccatcgtcgccgcccagttcgcatacatcgtcaccagcagccgctgccgcctcacctggaggggcttctcgtggcaggccttctccggcctgcccagcttcttcaggctctccctcgcatccgccgtcatgctctgcctcgagacctggtacttccagatcctcgtgctcatcgcaggcctcctcaaggaccccgagcttgccttggcctcactctctgtctgcatgacaatttcagggtgggtgttcatgatctccgttgggttcaatgcagcagccagcgtaagagtgagcaacgagctcggcgccggcaacccaagggcggcggcgttctccgtggtggtagtgacgctgctctccttcgtcctgtcggtcctcgtctccgccgtcatcctgctgtgccgggactacatcagctacatcttcaccgagggtgaggacgtgtcgcaggcggtctcccggctcaccccgctgctggcgttcacgctcatcctcaacggcatccagcccgtcctctctggggtcgctgtggggtgtggatggcaggcgttcgtcgcgtacgtcaacgtcggctgctactacatcgtcggcatcccgctcgggtgcctcctaggcttctactttgacctcggagcagcgggtatttggagcggtatgatcggcggcaccttgatgcagaccttgatcttgatatgggttacattcaggaccaactggaacaaggaggttgaagaagcacagaagaggataaacaaatgggacgacggcaaggctcctctgctgtcagcgcaagaatgaaacaactcgtctctctggtgcccaaccaaagaacaacgagacgtggatatatatgacctgtagggcttgtttggaagaaagagtattggagaggattgaaggggttataatctcttgctattcaaaattgaataacaagggattatagtccccacaatctccttcaatactcttgtttccaaacatacccgtagggaactagggatgcccctcggcaggctcagcggagacgtcgacggagtttgatgtcaagtagcaattaattccaccatgtcctcaaatggacagaaccagatgcctgaaatagacagaaccagatgcctgatgaaattctacgtactc

SEQ ID NO: 7532 - DNA, 1588 bp, Zea mays
attcggtaatttttttggaagcccaagtccagagcgggtccagcccagttcatcctccacctgctccgccggctgctcttcttctcccctctcgctatatccccggggacctcacagccacatctctccactgctccgtccagcgcgtccacctcccaaacccctactcccccaggaagcaatggcttcccccacccagggccaggtcatcacctgcaaagcggcggtggcgtacgagccgaacaagccgctcgtgatcgaggacgtgcaggtggcgccgccgcaggccggcgaggtccgcgtcaagatcctcttcaccgcgctctgccacaccgaccactacacctggagcggcaaggatcctgagggtctttttccttgcattcttggccacgaagctgccggaattgtggaaagtgtcggtgaaggagtaactgatgtgcagcctggggatcatgtcattccttgctaccaagcagaatgcaaggaatgcaagttttgcaagagcggaaagaccaacctctgtggtaaggtccgaagtgccacaggcgtaggtgtcatgatgaatgatatgaagagcaggttctctgtaaatggaaaacccatttaccatttcatggggacatcaacattcagccagtacactgtggtgcatgatgtcagtgttgcaaagatcaacccacaggcacccttagataaagtctgcctgctcggttgtggtgttcctactggtcttggagcggtgtggaatactgcaaaggttgaatctggctcagttgttgctgtttttggccttggaacagttggacttgcagttgctgagggagcaaaagctgctggtgcttctcgagttattggcattgacatcgacaataaaaagtttgatgttgcaaagaactttggagttacagaatttgttaacccaaaagagcatgacaaaccgatacagcaggtcctggtcgatcttacagatggcggcgtggattacagctttgagtgcattggaaatgtttcggttatgagggctgcactggaatgctgccacaagggctggggaacctccgtcatcgtcggcgtcgccgcctctggccaggagatcgccacacgaccattccagctcgtgactgggcgtgtctggaagggaaccgctttcggtggcttcaagagccggacccaggtcccatggcttgttgacaagtacatgaaaaaggaaattaaggtggacgagtacattacgcacaacatgaacctggctgacatcaacgacgccttccacctgctgcacgaaggtggctgtctgcgttgtgtgctggcaatgcagatttgaaattcctaagctaagcagtttttgttttggaactagaactcctttttgcctcgttaggcctggacccgctgtataatgctatgttgtgttggatggctgacgatggttactgctgtgttgctagcaatgtggtacttgatctgtatcacggttgcaaataagtgctgtttctaaaacactccctctcggtgaataaggggttgtttggtttgaggaatcattccatccaaattgaggtggtgcatcatagatctattcctc

SEQ ID NO: 7533 - DNA, 929 bp, Zea mays
gagagaagtccagacgattcagcgaccgctcttgacgaagctataaaagcgtcaccccacaaggccacaactcgtcccaacccaatcccaatccagagcgaagatcgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcaccgcgtggagcgcagcagcggccagttcgtgcggcgcttccgcctccccgagaacgccaagaccgaggaggtgagggccgcgctggagaacggcgtgctcacggtcaccgtgcccaaggccgaggtcaagaagcctgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctgcgagtgaataaataaaaacaaaccagctgtcgtctcgtgt

SEQ ID NO: 7534 - DNA, 2286 bp, Zea mays
cgatggtaaaagaggatgaaggccatggcgacagagtggccgccgacgctcctttccgtgtagtttaggactgcagattccttcgcgctcctcctgctcccagcgaggaaaagagagcacgaactaaactaggaaccatccctccccggcattcattcccttgccctttttttcaccgaattgtagcggttgttgctttcctgttcaggtgccttgttcttggcctccttcgcacgcaaagaaccgccggtcgtattgctctccgcactcacccaccgcgctgctgctgctcgactgctcgtggaagggttcttattggccgcctgtgcctgctttgcggtttcttgctctgcttttgagtggagccgctgtggagtggacggtgtggtgtgggtcggcggtgaggtgaaaggcttggtttctttctttcttgcgagggaggataagggaaagggaaggcgaagaggaggatggccggaggaggggcggcgccgccgccgaagcaggaggagctgcagccgcacccggtgaaggaccagcttcccagcgtgtcctactgcatcacaagcccaccgccctggcctgaggctgtcatccttggattccagcactacattgtgatgctgggcacatccgtcatcataccaagtgctcttgttccccagatgggaggaggaaacgaggagaaggccagggtgattcagacgctgctgttcgttgccggcatcaacaccctatgccagtcattctttgggactcgcctcccagcggtgatgggtggatcctacaccatcgtcgcacccaccatttccatcatcatggccggccgttacagcaacgaagcagaccctcgtgagaaattcttgcggaccatgcgaggaacacaaggcgctctcatcatcgcgtcgacaattcagatcgtgcttggtttcagtggcctttggcgcaatgtcgttaaattgctgagcccattgtctgctgtacctttggtttcgctagctggatttgggctatatgagctaggttttccaggggttgctaagtgtgtggaaattgggcttccggaaatcatcctaatgctcatattttctcagtacttacctcatgctgtccatgcggcaaagcctgtgttcgaccggttttctgtgattttcacaattgcgattgtatggctgtatgcgtacattctcacggttagcggtgcctacaagagtgcccgaacaaagacacaactccattgccgtgttgaccgctctgggcttgttggtggagctccttggattagtgtcccatatcctttccaatggggggccccaacatttgatgctggtgaatcatttgcaatgatggtggccgcatttgttgctcttgttgagtcatctggggccttcattgctgtgtcaagatatgcaagcgcgactatgatacctccttcagttcttggtcgtggcattggttggcagggcatcggtactttactgggtgcgttttttgggacagctaatggaactgcagtgtcagttgagaatgctggtctgcttgctttgacacatgttggcagccggagagtagtccagatatctgcaggcttcatgatcttcttctctgtccttgggaaattcggggcgatctttgcttcaatcccactgccgatattcgctgccctgtattgcattctctttgcatacattggtgcttgtggcctgagcttccttcagttctgcaacctgaacagcttcaggaccaagttcatcatggggttctccttgttcatgggcctgtcagtaccccaatacttcaacgagtacacgtccgtggctggctatggccccgtgcacaccggcgcccgatggttcaacgacatgatcaacgtgcccttctcgtcgaagccgttcgtggctgtgctggtggccttcttactggacaacacgatccaggtgcgtgacagcggcgtgaggagggacaggggctaccactggtgggacaagttccggagcttcaagacggacagccgcagcgaggagttctactcgctgcccttcaacctcaacaagtttttcccttccgtctgatcctgcagggtctgcacactcttcctcgcagccgcagtagccctgactggagtcaggcaagaaatgatcctatgcagatgatgctggagcatggactgatggcgttttgtacattcaggggtgaactgaactgtgcaggttgcaggggatagtgctctgggtagcatcagtattccctagtaaccgaaattgaaaaggccgcctgttaaacttc

SEQ ID NO: 7535 - DNA, 1600 bp, Zea mays
gtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggtatctaatcagccatcccatttgtgatctttgtcagtagatatgatacaacaactcgcggttgacttgcgccttcttggcggcttatctgtcttaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactataagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggtatctgtatcagtattcatgtgtttgttt

SEQ ID NO: 7536 - DNA, 2675 bp, Zea mays
cgcgtctcccacacggccgccgccctcgccttcgtgcgttccccgcgtagagtttagggttttgtcgccgccatggcgatcctctcggcgctcgccaccgaggtgttcatccccgtcgccgccgtcatcggcatcgccttcgccgtcgtgcagtgggtgctcgtgtcgcgggtgaagctctccccggctgcagccgcgtccggcggcagcaagaacggctacggcgactacctcatcgaggaggaggaggggctcaacgaccacaacgtcgtcgtcaagtgcgccgagatccagaccgctatctccgaaggagcaacatcgtttcttttcactgagtaccaatatgttggtatcttcatgtccatctttgctgttgtgatcttcctcttccttggttcggttgagggattcagcacgaagagccagccctgcacctatagcaaggacaagtactgcaagcctgcactgttcactgcactctttagcactgtgtccttcttgcttggagccatcacctctctggtctccggtttccttggcatgaagattgccacatatgcgaatgccagaactaccctggaagctaggaagggtgttggcaaggcttttatcaccgcttttcgctctggtgctgttatgggcttcctgcttgcatcaagtgggcttgtggttctgtacatcaccattaatgtatttaagttgtattacggtgatgactgggagggtctttttgagtctatcactggctatggccttggtgggtcgtccatggctctctttggaagagttggtggaggcatctacacaaaggctgctgacgttggtgctgatcttgttggaaaggtcgagaggaacattcctgaggatgatcctaggaacccagctgtgattgctgataatgtcggtgacaatgttggtgacattgctggaatgggatctgatctctttgggtcatatgcagagtcttcctgtgctgcccttgttgttgcgtctatttcatctttcggaatcaaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccactgtcctgatgactgttggtattgctgtaatcagctggttggcccttccagctaagtttaccatcttcaactttggtactcagaaggatgtctccaactggggcttgttcttctgtgttgcaattggtctgtgggctggtctgattattggttttgtcacagaatactacactagcaatgcatacagtcctgtgcaagacgttgcagattcttgcagaactggtgctgccactaatgtcatttttggtcttgctcttggatacaagtcagttatcatcccgattttcgctatcgctgttagcatctatgtcagtttctccattgctgcaatgtacggcatcgcagttgccgctcttggtatgctgagcacaattgcaactggtcttgctattgatgcttatggtcccatcagtgacaatgctggtggtattgctgagatggctggaatgagtcacagaatccgtgagagaactgatgctcttgatgctgctggcaacaccactgccgctattggaaagggatttgccattggttcagctgctcttgtgtctctggcgctttttggtgccttcgtcagcagagctggagtgaaggttgtcgatgtcctctcccccaaggttttcattggtttgattgttggagccatgcttccctattggttctctgccatgaccatgaagagtgttggaagtgccgccctaaagatggtggaggaggtccgcagacagttcaacaccattcctgggttgatggagggaactgccaagcctgactatgcaacctgtgtgaagatctccactgatgcttccatcaaggagatgattcctcctggtgctctggtcatgctcactcccctcattgttggaaccctcttcggtgttgagactctctctggtgttcttgccggtgccctggtttctggagtgcagattgccatctctgcttccaacaccggtggtgcatgggacaatgctaagaagtacattgaggctggtgccagcgagcatgccaggaccctcggccccaagggatctgactgccacaaggctgctgtgataggtgacaccattggtgaccccctgaaggacacctcgggcccgtccctcaacatcctgatcaagctcatggcggtggagtcccttgtgtttgcccccttcttcgccacccacggtggcctgctgttcaagtacctgtaagggccacaccaatcatcacagcagaaatatacgaccgaccgaccgtggacatctcgaataactcctgccaaatcgccagttcatgtgtattgtgcgctagccgcctagctgcactgctgtttttttggtctcattgttcgtattttctccttggcccctccccctagaggcgttactgttagccttactcttactccctgtagctgcacgtagaagagaactgttgtcctgcaggtctggcaaattttcccagtctcttgatgatggcgatgatgttgaaatctttgaacaatgatacatgattgttgcatttt

SEQ ID NO: 7537 - DNA, 3819 bp, Zea mays
gcagcagcaccaccactgcgcggcattgcagcgagcgagcgggagggatctggggcatggtggcggtcgctgccgctgccgctcggatctagagggccgcacggtatccgccggcctcgtcggtgtcggtgtcggtgtcggtggagtgtgaatcggtgtctgtaggaggagcgcgaagatggcggccaacaaggggatggtggcaggctctcacaaccgcaacgagttcgtcatgatccgccacgacggcgacgcgcctgtcccggctaagcccacgaagagtgcgaatgggcaggtctgccagatttgtggcgacactgttggcgtttcagccactggtgatgtctttgttgcctgcaatgagtgtgccttccctgtctgccgcccttgctatgagtacgagcgcaaggaagggaaccaatgctgccctcagtgcaagactagatacaagagacagaaaggtagccctcgagttcatggtgatgatgaggaggaagatgttgatgacctggacaatgaattcaactataagcaaggcaatgggaagggcccagagtggcagcttcaaggagatgacgctgatctgtcttcatctgctcgccatgacccacaccatcggattccacgccttacaagtggacaacagatatctggagagatccctgatgcatcccctgaccgtcattctatccgcagtccaacatcgagctatgttgatccaagcgttccagttcctgtgaggattgtggacccctcgaaggacttgaattcctatgggcttaatagtgttgactggaaggaaagagttgagagctggagggttaaacaggacaaaaatatgttgcaagtgactaataaatatccagaggctagaggagacatggaggggactggctcaaatggagaagatatgcaaatggttgatgatgcacgcctacctttgagccgcattgtgccaatttcctcaaaccagctcaacctttaccggatagtaatcattctccgtcttatcatcctgtgcttcttcttccaatatcgtatcagtcatccagtgcgtaatgcttatggattgtggctagtatctgttatctgtgaggtctggtttgccttgtcctggcttctagatcagttcccaaaatggtatccaatcaaccgtgagacatatctcgacaggcttgcattgaggtatgatagagagggagagccatcacagctggctcccattgatgtctttgtcagtacagtggatccattgaaggaacctccactgatcacagccaacactgttttgtccattcttgctgtggattaccctgttgacaaagtgtcatgctatgtttctgatgatggctcagctatgctgacttttgagtctctctctgaaactgccgaatttgctagaaagtgggttcccttttgtaagaagcacaatattgaaccaagagctccagaattttactttgctcaaaaaatagattacctgaaggacaaaattcaaccttcatttgttaaggaaagacgagcaatgaagagagagtatgaagaattcaaaataagaatcaatgcccttgttgccaaagcacagaaagtgcctgaagaggggtggaccatggctgatggaactgcttggcctgggaataaccctagggaccatcctggcatgattcaggtgttcttggggcacagtggtgggcttgacactgatggaaatgaattaccacgtcttgtctatgtctctcgtgaaaagagaccaggctttcagcatcacaagaaggctggtgcaatgaatgcactgattcgtgtatctgctgtgctgacaaatggtgcctatcttctcaatgtggattgtgaccattacttcaatagcagcaaagctcttagagaagcaatgtgcttcatgatggatccagctctaggaaggaaaacttgttatgtacaatttccacaaagatttgatggcattgacttgcacgatcgatatgctaataggaacatagtcttctttgatatcaacatgaaaggtctagatggcattcagggtccagtctatgtgggaacaggatgctgtttcaataggcaggctttgtatggatatgatcctgttttgactgaagctgatctggaacctaacattgttgttaagagctgctgtggtagaaggaagagaaagaacaagagttatatggatagtcaaagccgtattatgaagagaacagaatcttcagctcccatctttaacatggaagacatcgaggagggtattgaaggttatgaggatgaaaggtcagtgcttatgtcccagaggaaattggagaaacgctttggtcagtctccaatcttcattgcatccacctttatgactcaaggtggcataccaccttcaacaaacccagcttctctactgaaggaagctatccatgttatcagctgtgggtacgaggacaaaactgaatggggaaaagagattggctggatctatggttcagttacagaggatattctgactgggtttaaaatgcatgcaagaggctggcaatcaatctactgcatgccaccacgaccttgtttcaagggttctgcaccaatcaatctttctgatcgtcttaatcaggtgctccgttgggctcttgggtcagtggaaattctgcttagcagacattgtcctatatggtatggctacaatgggcgattgaagcttttggagaggctggcttacattaacaccattgtttatccaatcacatctgttccgcttatcgcctattgtgtgcttcctgctatctgtcttcttaccaataaatttatcattcctgagattagtaattatgctggaatgttcttcattcttctttttgcctccattttcgcaactggtatattggagctcagatggagtggtgttggcattgaagattggtggagaaatgagcagttttgggttattggtggcacctctgcccatctcttcgcggtgttccagggtctgctgaaagtgttggctgggattgataccaacttcacagttacctcaaaggcatctgatgaggatggcgactttgctgagctatatgtgttcaagtggaccagtttgctcatccctccgaccactgttcttgtcattaacctggtcggaatggtggcaggaatttcgtatgccattaacagcggctaccaatcctggggtccgctctttggaaagctgttcttctcgatctgggtgatcctccatctctaccccttcctcaagggtctcatgggcaggcagaaccgcacgccaacaatcgtcatcgtttggtccatcctccttgcgtctatcttctccttgctgtgggtgaagatcgatcctttcatctccccgacacagaaagctgccgccttggggcaatgtggtgtgaactgctgatccagattgtgactcttatctgaagaggctcagccaaagatctgccccctcgtgtaaatacctgagggggctagatgggaattttttgttgtagatgaggatggatctgcatccaagttatgcctctgtttattagcttcttcggtgccggtgctgctgcagacaatcatggagcctttctaccttgcttgtagtgctggccagcagcgtaaattgtgaattctgcatttttttatacgtggtgtttattgttttagagtaaattatcatttgtttgaggtaactattcacacgaactatatggcaatgctgttatttatacgcaaagactgatacattcttcggattgtgagcaaacagtcagaacactgtaatctcttaggacaactatataaggcagctgttgtatcatctct

SEQ ID NO: 7538 - DNA, 1551 bp, Zea mays
cttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgct

SEQ ID NO: 7539 - DNA, 1792 bp, Zea mays
ggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccatcaggcggtggtgaacaatctggatgacgcgcacgagcagatcgacacggccattgccacggcactgagggagagcaagcccgtgtacctcagcatcagctgcaacctccctgggctgcctcatcctaccttcagccgcgacccagtgcccttcttcctcacccccaggacgagcaacaagatggggctagaggctgcagtggaggcaactgtcgaattcctgaacaaggcggtgaagccagtccttgtcgccggccccaaactgcgtgtggcaaaggcaggaaaggcatttgtcgatatggtagatgccagtggctatgcctatgccgtgatgccatcggccaagggtcttgtgccagagacgcacccccacttcatcggcacctactggggcgcagtcagcaccgccttctgtgccgagattgttgagtccgcagatgcctacctctttacaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagagggttaataagaacaccactgcctatgagaattacaagaggatctttgtacctgagggacagccgctggaaagcgagccaaatgagccactgcgagtgaatgtgctcttcaagcacgtccagaagatgttgactggtgatagtgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcgagggcaagtgctggacctccaaggtgaagagcgaggaggagctgacggctgctattgagacagcgctaggggagaagaaggactgcctgtgcttcatcgaggtgatcgcgcacaaggacgacaccagcaaagagctgctggaatggggctctagggtttctgccgccaactcccggccaccaaatcctcagtagaagtcccgcaggctccaagcctcggagtgccagtagtgatagtaagctgtagcacggtgggggctcaactgaataacgtgaacgcattgccctttctgttacgtgttttattttattgtgtttctgtggtcgtatatctgttttgtgacgtgtcccttgcttctcccatgtgaattccagaagaactatgagaaatttcaggttggtgatcact

SEQ ID NO: 7540 - DNA, 1332 bp, Zea mays
gcatccgtccgggcctcctcgtctccccagccccgctgccgccgggttcatcagcagaagctgcttgctccgccgccgccgccctcttcctcctctactggcgtgcccatgaagccattggggtcgtcaggagggcgttcgtgagcggcatgcgccacgacagcttcaaggcggtgcaggtgctcacagcgtgcgcccgcgtcacggatctagagaccggggaggccgtgtggagggcggcacaacaggagggggtcacggagagcgtgttcgtggcgaccacggcgttggacctgtacgtcaagtgcggggagatggagaaggctagggcagtgtttgacgagatgaagaacaaggatgcggtggcctggagcgcgatagtcagagggtacgcctccaacgaacatcctcgggaggctctagaccttttcttcgcgatggaggtggagggagcgaagccggattgttacacggcggtcggggcgctctcagcgtgcacgaggttaggtgcattggatttgggacgacaggcggttgaaatagtgcactaggatgaggtccttgacaacccagtcctgggcactgcactgatcgatatgtatgctaagtgttggagcacaagagaggcatggatggtgttccagcagatgttggagagggacatcattgtttggaatgcgatgatcatggggcttggcatgattggccacgagaagattgcatttgtgcttgttggccagatgaagaactcgggtgtgaagctgaatgataataccttcattggattgctctgcagctgcacacatactagccttgtgaatgatgggcggcggtattttcataacatgactcatgtatacagtataagccctaggattgagcattatggttgtatggttgacctgttgagtcgtgcgggattgctggaggaggctcatcagctgattggtgacatgccaatgctggcaaatgccgttgtatggggagcacgcctcggtggttgcaagatccatcggaatgctgaccttgctgaatatgtgctgaagcagctcatccgactggagccatggaattctgggaactatgtcatgctttctaacatttactcgaacagtggaagatgggaagatgctgcaaagcttaggttggaaatgaaggcaaaggggattgagaaggtcgctgcctctagctgggttgagcttgatgataaggtccacaagttctatgttggggacgattcacatcctctttcagataagatctatgcaaagcttgatgaattgggccacggcataccttgtagattgagcccatagcagcccatatatgaag

SEQ ID NO: 7541 - DNA, 974 bp, Zea mays
cgaagctttcagccgatcgagcaccatcgtcacagtcagtagtagccaagcatatttctttctccgagtgatttgcgctgagcgatcagttcatccagagcgagcggagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggccgccaagcagaaggcagccgacgccatggaggccgccaagcagaaggccgccgaggccgggcagtacgccaaggacaccgctgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaaggactcctctaccatcaccagggatcactagacgcgtgtatgcacacgcacttggtccgatcctgtcgtccgtgaccctgtttgcttgttcgcgagtccagtatgggtttgtgcacgttttcagtgtcatggtttccttctctacgaaatttggtgttgtaagtttgattcgcaggtacgttgctgtgttttttctgcgtcatcatgtctgtaaacgagtcgggcgggtttgagtgtcctttgttgtgataataaagttggtaaatcgtaattaatatatagcatgcgactgtcttgcta

SEQ ID NO: 7542 - DNA, 1528 bp, Zea mays
ctagagttaaaaaaacacttacagcacgcagttgtcgtcgtcattgtcttcgactcttcgtggcacctcccgtccataaaaataaacgtgtgcccacaaatctgttcgctcgcattggcaactgaaccgcaccaggcaccacagtcccgtgcggcagtggcagacgcacagcagatcagcagcgcctccctctgcggctctgcctcttgccaaagccccccacagaattcttctccctccccgtctcctctcgcgctcgcgcgtggtgaggtgaggtggagttccgaccccgaggccgcaatggcgacagcggaggtggtggtggccaacggctcgggcggcgccgacaccaagaccgcgtttaaggagatatacagcaagctcaagcaggagatgctcgaggaccccgccttcgaattcactgacgagtcgctccagtggatcgaccgcatgttggattacaatgtgcttggaggaaagtgcaatcgtgggctatctgttgtcgatagctacaagattttgaagggtgttgacgttctgagcaaggaggagacatttctggcctgcacccttggctggtgtattgaatggcttcaagcttattttcttgtgcttgatgatattatggacaactcccagacacggcgtggccagccttgctggtttagagtgccacaggttggtctcattgcagtaaatgatgggattatccttcgcaatcatatctcacgaatccttcaacgccacttcaaaggaaagccatattatgttgatatcattgacttgttcaacgaggttgagttcaagacagcttcagggcaaatgttggatcttatcactacccacgagggtgaaaaggatctaactaaatataacttgacagttcaccgccgcatcgttcagtacaagacagcttattattcattctaccttcctgttgcatgtgcattgctgctggctggtgagaacttggaaaactttgttgatgtaaagaacattctcgttgaaatgggaacatactttcaagttcaggatgactatctagattgttttggtgatcctgaattcattggcaagatcggaactgacattgaagactacaaatgttcctggctagttgtgcaagctcttgagcgtgctgctgagaaccaaaagagcattctgtttgaaaattacggaaagtctgatccagcgtgtgttgcaaaggtgaaggacttgtacaaagagcttaaactggaggaggttttccatgagtacgagagggagagttacaacaagctgattgccgacatcgaggcccagccgagcaaggcagtccaaactgttttgaagtccttccttcacaagatctacaagagggacaagtagacccagatcgtcgacaagctgctccatcgacgcttgcatcaatcgaattactatacttgattgatgcggacgagtaatttgtactatgttgttttgtgttttcattctcctgttgtacggtacaccttaatataataaagcacagtggtactagggatgc

SEQ ID NO: 7543 - DNA, 1683 bp, Zea mays
cagcctccaggcccatgtgaaacggtggatggcccgccctacgcgacccgggttctgcaccctgccgtttcttctccattattcccagcgggcgcgctcgctctctctttctccctcccctcctcgtggcgacgattgggggcagtcgctgccgccgtacgccaggtgcccagatcttcttcatgcccttctccagcgacgagtatcagaagctgtttgtgcttttaaggatgcataagcgtatggcggttttgatggtatccattgtttgaacgatgggaggatagaagaccattctctgcataaataggcttcataagtattattgctttattgctttaatattatcatatgattgagtgcacaatgccatcaaccttacttgatgatctccctaacgaagttgctctccagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgatcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcaagggtaagatgcatgtattgcataaaggtctatcgacagttcagattctggaagatggtggcagtcattgggctgttgaggatttctcttggttgcaaggcccgatggcgatggtcggtggagagctgtatgtgctgagtaacagctgtattatgaagcaacgtggtgagaacttccctgataagatggtatcgtgtgcatctgagttccagagcaggatcggtttcgggatgattggtgtgggtgacaacatatatttggttggaggagtgattggacctgggccgagaaaccaatgcatcaagctgctctctgatgttgatatcttgaacgtcacaagtgagagaccaacctggagaccagggtcgccgatgacgcattgccgagggagcatctgtggctgcgctttgttgaggatttagcgtcttcccagtgtgatagtgtgagtattccaccattgctgaactgatcggtgacgtcctaagttttattttattttcaaaagggttgttatttacgctttccttttggatcctttgtagcattgagggcatgactcaatgttggattgccaatgagatatatactatattgaccatgaacagtgttccagaacacactatatacttcatcattttcatttggcatttaaatattttggtggttttaaatgacatcttgctggtttgaat

SEQ ID NO: 7544 - DNA, 1135 bp, Zea mays
cacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatagtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagagcttgagggattgaatgttgaagaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtggagctgcggcctcagcggataggcacttgtgtatggttttatggacgaccggcccccgactacgtactgcaataatcttgcattggaagcgagatcggttaacctgatttgtcatcccttgtggcttcatgatgcgatgttccgcttgtaccgtttgctagcatgttaactgaatttttagaatcgcatatacttttgttcctatatatcactgtcgtactgctcgt

SEQ ID NO: 7545 - DNA, 830 bp, Zea mays; identical to SEQ ID NO: 7530

SEQ ID NO: 7546 - DNA, 801 bp, Zea mays
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaag

SEQ ID NO: 7547 - DNA, 1467 bp, Zea mays
accgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaatggctggtctcagtggtctatacgtatgctttttggttctcttgattcctcacagggtgagtgggggcatgagcatttctctgtctcatctcaatgatgtaagttttctgtttggtgtctcgttccaagatgacttcagaatccgtaaatctctgaagtctaaacgctctatctaaacctttggattcgattacaattgtagatatagaaatctgtagaagggtgcaattcagaatactttgccatgaaatgaatatccttcttgtgagactctgtattaagactaaaacagctcaaattgatagagattctgtgattccttccc

SEQ ID NO: 7548 - DNA, 1140 bp, Zea mays
gggaagaacaatcgagctactaataaggtcgtatacatatcttctatatactcctctgaaagttgtgaactccggtcgagcttaaaaacagcagcaatggcgaagctttggacattgctgctggctgcagtggtggtcctctcactcctagtgagccccattgcttgcacccgaaagctcaacaaacccaagccgaagccgggcagctacaggcggccggtcaagccgaagccaaaaccggtcacgggcagctacaagccggcgcctgtggccgccagaagaaaccacacagctacacccacgccatcgccgactgtctacggccccggtggctggctgtcaggcgccggcgccacgtactacggcgcgaccaacggcgacgggagcgacggcggcgcgtgcggctaccagacggccgtcggaaagaagccattcgactcgatgatcgccgccgggagcacgccactgtacaggggaggcgagggctgcggcgcctgctacgaggtgaaatgcacgaccaacgccgcgtgctccggccagcccgtgaccatcgtaatcaccgaccagtcccctggcgggctgttccccggcgaggtcgagcactttgacatgagcggcaccgccatgggcgccatggcccggcccggcatggccgacaagctccgcgctggcggcgtgctcaggatcctgtacaggagggtgccgtgcaagtacaccggcgtcaacatcgcgttcaaggtggatcagggcgcgaacccgtactacttcgacgtgctcatcgagttcgaggacgacgacggcgacctcagcgccgtggacctcatggaggccggcagcggcgtctggactcctatggcgcacaactggggcgccacgtggcgcctcaacaacggcaggaagctcaaagcgccgttcgggctccggctcacctccgactcccgcagggtgctcgtcgccaacaacgccatcccggccgcgtggaagcccggcaagacctaccgctccttggtcaactacccctgaaaagagaaataccgacaagtggatggcgtgtattgtgcgtccgggtgttgcgagtggcggcggtgtactactggtgtcggaaaacagaagagaatgaaagaggaggttgaagaagag

SEQ ID NO: 7549 - DNA, 1802 bp, Zea mays
cgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 7550 - DNA, 799 bp, Zea mays
tccccatccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgatcttagactcccaactgatgagactcttgtggcccagatcaaggaagggtttgaaagtggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatgtcaaacacaagtgcagggatcgctgggtgttgcaccgtgtctgcattatctgtggttacattctggaccctgtattttctatgcttttatgcccctactgtttagtattaattatcaataaatttgtttgggacggttg

SEQ ID NO: 7551 - DNA, 1636 bp, Zea mays
ccctcttctctcatcgttgattcgattttcctcgcccctggagcttcaaattcaagtgaaggagccagttaaggcttgccaaaactagcggcggcatcggcaatgctctagttggcctttccttccctcccagctcgagcagcgcagcgcggccctctttatctctctcggcagtggaggcagcgtcacccttcgcctaaatcaccaccaccagctctggagcgctgcgtcgccgctcctctaccatttcctggtagattggaccggaacggactaacggagtggagttctgctattgatcattgtgagttcatccccactccaatccatctgtccatggtccgtatgagctcatcttcctcggcgtctggggtcaatctgacagagcaaatcgagaatgtttttgaccaactgatcagcaaaattgaacaagcggatccagattttgacccgcggccctttttgaaacaattgaatgtgttaggccgctatgaaccaatcaagcggaatgtatatttcactaagagatacattgaagattatggcatttcttgtcactgtaagccttctcctggttcatcagttgtgtgtggcagagactgctattgtagcatgcttttctcttgctgttcatcacaatgtgaatgtgatattgcgtgcaccaataaatcattccagcacagacctcttacgaaaaccaaattgattaagacagagaaatgtggtcatggattggttgctgaggatgaaataaagaaaggagaatttgttattgagtatgttggagaagttattgatgacagaacatgtgagaataggctatggacaatgaaaaggctggatgacactgacttctacctttgtgaggtcagcagtaatatggtcattgatgcaacaaacaagggaaacctgtcccgatttataaaccatagttgtgaaccaaacacagcgatgcagaaatggactgttgatggagagaccagggttggaatttttgcacttcgtgacataaagataggggaggagctgacatatgactataaatttgtccagtttggagcagctcaggtttgtcattgtggatcttcaaagtgcagaaaaatgctaggcacaacaaagtattcaggaagctcacagaatcatcgtaccaagaagaaaaagaggaaaacaagttgtgagaattgcatacagcagtttcttcgtctgtggcatccacgacaaaaaatgtatgttggatgttggatagttgacttcgatcaaggaactaaaatgcatactctccagttcattgatcaccatactgaaaagtttgatttgaaagaagaagaatggcacttcttggaggtcgactctgatgaagattgatcattgaaggtaactgtaagagttcactaccacaattcttgtttttgtaatcagatgattcatttatgcaaatcccaattctgtgtcaaatatagttttcaaaagatgttttaccatcattttttgctttgctttattgttcagttttattgcatccttgtacaaggaatagtcgtgcaagatgatattggcatgaggtgtggttaagtctcaacttccaattatgttgtgcatctttggaaaatgtaatctggccagtaacctttggagg

SEQ ID NO: 7552 - DNA, 2309 bp, Zea mays
ccatcacaccatccccactctctcctctccacccggcgagcggacacccccctgtcctcttgacccgatcccgtccccgcccgcccgccccgccgccgcgcgcgctggtccggacgctcgggcgctggtgatccggttgatgcagcagcggggcctcgcccacaactgccgctcccgcggcttctcccgctcccgccgcgcagtcgagggcgcctgaaacgcacccgccccacgcacgcagggcaaccgaaaacccctcgatccggctctcctcgcgctgtagcttttataacgccgtagacgacaacgaaagagaacggaaagaaataaaacccaccacacctaccgtcgtccgtaaaggaaggaaggactcgagatggacaccgtcggcgtccccgtggtggccgttgcgaatgggatcggggaggtggagcgcaaggtgcagaagagctactgggaggagcactccaagtgcctcactgtcgagtccatgatgctcgactcccgcgccgccgacctcgacaaggaagagcgacccgagatcctgtctttgcttccctcttacaaagggaaatcagttctagaacttggtgctggaataggacgctttactggagatctggcaaaagaagctgggcacgttctggctctagacttcattgaaagtgtgattaagaagaaccaaagcataaatgggcatcacaagaacataaccttcaggtgtgctgatgtgacatctaacgacttgaagattgaagataactctgttgatctgatattttcaaactggctattaatgtacctttcagatgaggaggtccaaaagcttgtggggaaaatggtaaaatggctaaaggtcggaggccatattttctttagagaatcatgttttcaccaatctggagattccaaaaggaaggtgaacccaacacactatcgagaaccaaggttttataccaaggtatttaaagagggccattcatttgatcaagatggaggttcgtttgaactttctctagtgacctgtaaatgtattggggcttatgtcaaaaacaagaagaatcaaaaccagatatgctggttatgggaaaaggtaaaatcaacagaagacagagattttcaaagattcctggacaacgtgcaatacaaaacaagtgggatattacgttatgagcgtgtctttggtgaaggttttgtgagcactggtggaatcgagactacaaaggaatttgtgggcatgctcgatcttaaaccgggccagaaagtacttgatgtcggatgtggaattggaggcggcgacttttacatggctgcaaactatgatgtccatgttcttggtattgatctttcggtgaacatggtttcatttgcaattgaacgtgccattggacgcaagtgctctgttgaattcgaagttgctgattgcaccacaaaggattacccagaaaatagttttgacgtcatctacagccgtgacaccatccttcacatacaagacaagcctgctctgttcagaagcttcttcaaatggctaaagcccggcggcaaagtcctaatcagcgactactgtaagaatcctggaaaaccatcagaagaatttgctgcgtacattaagcagagaggctatgaccttcacgacgtgaaggcttatggacagatgctgaaggatgctggttttcataatgtcatcgcggaagatcgcactgagcagttcttgaatgttctacagagggagataggtgaagttgaaaagaacaaagacgctttcctggcagacttcacccaggaggactatgacgacattgtgaatggctggaacgcgaagctgaaacggagctctgccggcgagcagaggtgggggttgttcattgccaccaagtgatttggcctggcagcaggagggctcttcggaataagaatggatgtggctgtaactctgcttctagaccggtgatggttcagcttagaagcaggggatcttcatcatcagaataaaaacgtgtgctgttgtgttgctgtgtctacgccactagtatttctgttgttaacttatgttctaggtaaactgcgcagccagagcagagctgaagaatatgtactgcttgctcgctcttgtgtggttgtgtctaccctactagcatttcagctttgttgtaggtaaactgcgaacccagagttgcagaacccgtactgctcgtttaagctcatggtgaactacgagctaaaaggctgttgccagagtcgatgtcagtatgtcacttgtcactggaggtccccggttcagttcagatgttgctttggcacgtgct

SEQ ID NO: 7553 - DNA, 1069 bp, Zea mays
caccacaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggtcaaaccataatgtgtagtatttgtgtcgaactgtcaatggcacgtatttggattttcactac

SEQ ID NO: 7554 - DNA, 1418 bp, Zea mays
caccgctttaaatccgcctcctcccagcgtctccctcctcccggcctgtcccctcacctcctccccctatctctccaccgccgcagctagctgtgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgggctaggatttaggttgagatcaggagagggagaaggcggcggcgatggggcgcgggaaggtgcagctgaagcggatcgagaacaagatcaaccgccaggtgaccttctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccacctgagctgctgaaggtttgctctcatcgtcgcagtgtgctagcccaaaatccagcaagtcttccccggaccccggactggccaagcttctccgcctggtgcagtatcgtcgtgatcgcgagaagcagcagcagcggtttgccgtattttttaccaccgtgtataagtagcatatctgcaatgtgtatattttgttcaccgttcctgct

SEQ ID NO: 7555 - DNA, 1431 bp, Zea mays
gccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaatggctggtctcagtggtctatacgtatgctttttggttctcttgattcctcacagggtgagtgggggcatgagcatttctctgtctcatctcaatgatgtaagttttctgtttggtgtctcgttccaagatgacttcagaatccgtaaatctctgaagtctaaacgctctatctaaacctttggattcgattacaattgtagatatagaaatctgtagaagggtgcaattcagaatactttgccatgaaatgaatatccttcttgtgag

SEQ ID NO: 7556 - DNA, 1562 bp, Zea mays
ggaggacggacgggaggaggagaggagagagcccaccacccgcgaccgcgaccgcgacctaacccggagacctccctaggctagctcccctcccagaccccaggctctcccacccacctttcccctctccctccctcctccccgtcccacgccgccgcacccccgcctggctgcttgggtggcaatcggccgtagaggaggagggtgtaggagcttgatccgggccacctgccccctgcgccgtcgggatgtacgtgccgccgccgcccaccggcggcgccggcgagcagcctagggtttaccaggtctggcggggaagcaacgaattcttcttgcagggaagattcatatttgggcctgatgtgagatctgtgtttctcactatgttcctcatcatcgcaccagtggttgtcttctgtgtgttcgtcgcaaggcatctcataaatgatttccccgatagctggggaatctcagtgatggtagtagtggttgtcttcactgtttatgatttgacgctgcttctttgtacctctggtagagatcctggtataatacctcggaatactcatcctcctgaacctgaatccattgatgggatcaatgatacaggtgttcagactccacaacaatttcgtttgcctcgcacaaaggaagttgttgtaaatgggatcagtgtacgggtaaaatactgtgatacttgcatgttgtaccgaccacctcgatgctcacactgttccatttgcaataactgtgtggaacggtttgatcatcactgtccatgggtcggccagtgcataggactgcgtaattatcggttcttctatatgtttgtatcctcgacaacattgctctgcctgtatgtatttgccttctgttgggtgtatgtgatcaagattagagcagctgagcacttgtcaatttggaaggccttgttgaagacaccagcatcaattgttctgattatctactgttttctttgtgtatggtttgtgggtggtttatctgtcttccatttgtacctgatgggcactaaccagacaacatacgagaatttcaggtatcgctatgaccggcgcgataatccatataacagaggtactctgaacaattttctagagatattctgcaccgctatccccccttcgaagaacaatttccgggcaagggtgacagtagagcaagggctgcagcaaacacgctcacagtctaggggtttcatgagccccagcatgggcaagccaaccatcggagagcttgagatgggcaggaagccagtagtaccttgggacgagccaaggacggcagctgatatcagggacttggaagcagggttcgggggcatgtttgacgagaaagagggcagagtagcccacgcatccccagatctgagcagagatctcccagcagagtttgtggaagggcgaactggcatgcactcgaggcagtcaagttgggttcagagaggaggcgatgcgagtgaagcgtcggcgctgcaaatggctactgtccataccgccgaagatagcaaccatgtcccctggagtggcacacgttagcctgac

SEQ ID NO: 7557 - DNA, 1069 bp, Zea mays
cctcacttaaaccctcctccgctcgacgacaccacacgaaaatatacgtcagaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacatagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgaggacgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggcggcggtggcgtcagcaacagcggcaccaagcgagcccgcccatcatagctgcgacttttagtgatgtaaactgcttagaaaaactgttgcggacatagcgcccatcatagctgcgactttttaaatggtgctgtaaacttttgtagtgcgactaggccgtttgtcaccctatcatacttggcttcaagtaggttttttgtttttcagttttc

SEQ ID NO: 7558 - DNA, 1921 bp, Zea mays
gtattgagaacaagaaagcctctttcagttgaattgggacctggaattcttggaaacatttttgacggtatccagcgacctctaaaaaccatcgctattaagtcaggagatgtgtatattcctcgtggtgtttcagttcctgcccttgacaaagatgtattgtgggaatttcagccaacgaagctaggtgttggagatgtcatcacaggtggagatctatacgctactgtttttgagaacacattgatgcagcaccatgttgctcttccaccgggttctatggggaaaataagttacattgcaccagctggccagtacaacctgcaggacacagtgctagaattggaatttcagggcataaaaaagaaatttaccatgcttcagacatggcctgtgcgttcaccaaggcctgttgcatcgaagcttgctgcggatacacctcttctgacagggcagcgtgtactggatgcactattcccctcggttctgggaggcacttgtgctattccaggagcatttggctgtggtaaaactgtcattagtcaggcactttccaagtactccaattccgaagctgtggtttatgtgggctgtggtgaacgaggaaacgagatggctgaggttctcatggactttccccagttgacgatgacattgcctgatggccgtgaggagtctgtcatgaagagaacaacactggtggctaacacatcaaacatgcctgtcgctgctcgtgaagcttccatttacactggaattacaattgctgagtatttccgtgatatgggctacaacgtcagtatgatggctgactccacctcccggtgggctgaggcattgcgtgagatctcagggcgtttggctgaaatgcctgctgatagtggttacccagcttacttggctgcacgtttggcatccttttatgaacgtgctggtaaggtaaaatgtctgggaagtccagacaggaatggcagtgtcacaattgttggagctgtctctcctcctggtggtgatttttcagaccctgttacctccgcaaccctcagtattgttcaggtcttctggggtttagataaaaagctcgctcaaaggaagcatttcccatctgtgaattggctcatttcctattcgaaatactccaaggcccttgagtctttttacgagaaatttgatccagatttcattgatattaggacaaaagcacgtgaggtgttgcagagggaggacgatctgaatgaaattgtgcagcttgttggtaaagatgcgctggcagaatctgacaagattacgctggagacagcaaagcttttgagagaagattatttggcacaaaatgcattcaccccatatgataagttctgcccattctacaaatccgtttggatgatgcgcaacattattcacttcaacacattggcaaatcaggctgtggagcgggcagctggtactgacggccataagataacatacagtgtcataaagcatcggttgggggatctattttatcgcctagtatcccaaaagttcgaggatcctgcagaaggcgaagaagctttggtcggcaagtttaagaaactgtacgacgaccttaccactgggttccgcaacctagaagatgaggcacggtgaactgctgtagattttgtgtaagacaataatggctgccaaatggtttataaggtacggaagttgtagattgagaccatgtatgagaattttccccaccgctactcatttctttgccaccactattttagtcatcagtgctggatgggcaccctgtttatttcgacgtaccctttattgctagcattgtaataagcgatgggcatgcttgtagttgaataagtacaatgtccatgtattcaaacatcagcgtcatgtttatttgtttgttgaaaaaactatgttgcctttttgg

SEQ ID NO: 7559 - DNA, 1211 bp, Zea mays
cttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 7560 - DNA, 1730 bp, Zea mays
caacgtctcctccagtccttcgaaaaccctgaaaccttggtgaagccgagacgagtttgaggcaattatccaagcagctagtgctagcatctatggcgacctccgttcgtggtttcagtagcgccccctgcagggatgtgccgggcagctacggccttccgctggtgggcgccgtccgcgaccgcctcgacttctactacttccagggccaggacaagtacttcgagtcccgcgtggagcgctacggctccaccgtggtgcgcatgaacgtcccgccgggccccttcatggcgcgcgacccgcgggtggtggcggtcctggacgccaagagcttccccgtcctcttcgacatggacaaggtggagaagaaggacctgttcacgggcacctacatgccctccacctccctcaccggcggccaccgcgtctgcgcctacctcgacccctccgagcccacccacgccaaggtcaagcagctgctcttctccctcctgctctcccgcaaggacgacgtcatccccgtcttccgctccaacttctcctcgctgctcgccaccgtcgagtcggacctcgcccagggcggcaaggccgagttcaacaagctcaacgacgtcacctccttcgacttcatcggcgaggcctacttcggcgtgcgcccctcggcgacggacctcggcaagggcgggcccaccaaggcggccaagtggctcatctggcagctccacccgctcctcacgctcggcctccccatggtcctcgaggagccgctgctccacacgttccacctcccgcccttcctcgtcaagggcgactacggggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcatcctggccaacgtcgccagcgccggcgagaagctccacgagcggctcgtggctgagattcgaggcgccgtggccgaggccggcggcaaggtcaccctcgcggcggtggagaagatggagctggtcaagtcggtcgtgtgggagtcgctgcgcctagacccgcccgtcaagttccagtacggccacgccaagaaggacctgcaggtccagagccacgacgccgtgttccaggtgaagaagggcgagatgctgttcggctaccagccgtgcgccaccaaggacccccgcgtgttcggcgccacggccaaggagttcgtgcccggccggttcctcggcgaggagggcagcaagctgctgcagtacgtctactggtccaacggccgcgagaccgagaaccccaccgtcgacaacaagcagtgccccggcaagaactttgtggtgctcgtcggcaggctcttcctcgtcgagctcttcctccgttacgacaccttcaccgccgacatcggcaaggacctgctcggcagcagtgtcgtcttcaccagcgtcacgaaagctacctccggtccgggcagcgagtgaaccacccggcgtgtcgtcattggctgtggataggatatatgtttggacgtgagtacgtgacagggtcccatttcttaatttcgtctttaataagatactaggtgagtgcttttacattgcaacggaagcatataatattatgtataaatgtatgttatattgttatgagaaaatgttttgtaatct

SEQ ID NO: 7561 - DNA, 626 bp, Zea mays
agaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgttgactacatcatctctggccctgtggtggccatggtctgggagggcaagagcgtcgtcacaactggccgcaagatcattggcgccactaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaaaaatgtcaccatttgtgctttagcaatgttttcgaaaagattatgatctgtatcttggaaccttatttcaatggaccaaatttctttctttgcc

SEQ ID NO: 7562 - DNA, 964 bp, Zea mays
agatagacaggagagagagagagaggggaagagagagagagagagagagagagatagatgtggtaactcaagaactgttcttatgcatgcagcagccataagcattgctactagggtttcatgcggggcgaagcagctggtctctgccgcctgaacgccgccggaatctgcgaggcctccccgagctgcgtgcgtcgtcggataaggcagccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtgtgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggaacctcacctggtgcagagcagaagcccagcagctgagctgatagtgtccctgaaagtgctgtgagaccacctatgaaaaggatgctttgagtgcacatgtatagagttcttccctgaagcgattctttcactttcttttcttttgttttcttttgttttcttttcttttttggttcctcctcaccatctccaccccacccgtccacttctgcgttccttcgatggatctcgcgagcccgcggaataaatgagagttttggatatatagctagggcttaacctcgtcgacttgtctgtaaaatcgaatgagacatatatataaacctatgttgttttccttgtttctg

SEQ ID NO: 7563 - DNA, 1236 bp, Zea mays
gaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 7564 - DNA, 724 bp, Zea mays
ccttcccggccgatctgcatttccgtcgttccacaccgtcgttggccggcccatagctctccccctcctggttagtgtagtgagtgcagcgacgagtgcaacggtgagagataccgagatggctgagggaagaggcagtgcaagggccatcggcgccatggcgttcgccgttgcctgctgctgctgctgcgtcgccatcgccgacgcagccaccacctactacgtcggggacagcaacggctggtccttcagcagccccagctggcccaacggcaagcacttccgcgccggagacactctcgtgttcaggtacatcccctggatccacaacgtggtggccgtggacgaggacgggtacaacggctgcacgacgccgccggggtcgcggacctacacgtccggcgccgacagcgtcacgctcgccaggggggacaacttcttcatctgcacccggttcggccactgcaacctcggcatgaagctcgtcgtctatgccgcgtgatctgtcagagctagcgactggtggtggtattgttgactgggtgcgctcaatgatcggctgtgcttgctctcgagcgaactggtctgtttgatttgtgctatttcgtgtaggctcagtcagtcgcttggttctaatccgtaacggcttctactacttttacaatgttgttgtaacaatacaaacatccagctttaattgaagctaacggatatcgcatgtttg

SEQ ID NO: 7565 - DNA, 833 bp, Zea mays
gggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 7566 - DNA, 792 bp, Zea mays
ctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgcc

SEQ ID NO: 7567 - DNA, 1150 bp, Zea mays
ccgtccccgttttccacttttgcctccgccccaattcggataacaaacccctccgcctcgtcgcgtctcctcccagccgagccgatccggtagagagagggagagggagggactgagggaggaggagctgggttccggtcccggccgcccggccggctgcgcgattcgattgcagctctcgtccccgggcggcgtccaggatggtgcggggcaagacgcagatgaagcggatagagaacccgaccagccgccaggtcaccttctccaagcgccgcaacggcctgctcaagaaggcgttcgagctctccgtcctctgcgacgccgaggtcgccctcgtcgtcttctccccgcgcggcaagctctacgaattcgccagcggaagtgcgcagaaaacgattgaacgttatagaacatacacaaaggataatgtcagcaacaagacagtgcagcaggatattgagcgagtaaaagctgatgcggatggcctgtcaaagagactcgaagcacttgaagcttacaaaaggaaacttttgggtgagaggttggaagactgctccattgaagagctgcacagtttggaagtcaagcttgagaagagcctgcattgcatcaggggaagaaagactgagctgctggaggagcaagtccgtaagctgaagcagaaggagatgagtctgcgcaagagcaacgaagatttgcgtgaaaagtgcaagaagcagccgcctgtgccgatggcttcggcgccgcctcgtgcgccggcagtcgacaacgtggaggacggtcaccgggagccgaaggacgacgggatggacgtggagacggagctgtacataggattgcccggcagagactaccgctcaagcaaagacaaggctgcagtggcggtcaggtcaggctagcagctacctcagccacgcacaggcccaatcaacgcaagctagctagctgagaataatcttttagatctctggtagtgtggagatcgagatgcaagccaagcaatgtgatatcgcgttgtgtgttaccaacctgtcagtctgtgtatcatcccgtcccgtccgtcagagtctcagagaacgaacacttcttctccctgtagctagctgctcctgcttgtgtccagatcttctgttcgatcgggtttgggact

SEQ ID NO: 7568 - DNA, 1284 bp, Zea mays
cccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggccgcctcggagtccggagctgcgaaggtcaccggcaccgctgaggttccctacctcgccgacgagaacgccgacgaggaccccgacctccgcgtcaccgtgcgcggcgacgagacgcccctcgcgctccgcgccaaggacgccttcctctcccgcgggaaacccatggtgctcgagaagatccgggagttcgtcgctgccatggccaagggtggaccggccaaggacgagctggactccaagaaaactcccacgaaggtcgccggctccgcaccggcgaaggaggcggtactggctcctgcgccggctgtggagaagaaaaaggccaaggggaaggacaaggagggcttcaagaccattgagatgacggagaagttctactgccgctcaaaggacatatatgagatcttgatggatgagaacagatggaaagggtttacgcagagcaatgcgaggatcagcagagaggttggaggggaatttagcctcttcgacgggtccatcactggcgtcaacgaggagctgcaggaagggaagctgattgcacaaaagtggcggtttggaagctggcctgacggcttgtactcctcggtccggttggtgtttgatgagcccgagtctggagttacaatcataaagctcaaacaaactgatgtgccagaggaagacaagtatggaaattcaactgtggtagagaacaccgagagaggctggagagaactcatattccagcggatacgcggagtgttcggttttgggatctaaagaatctaaagaggcgatttggcatgaagttagatttcaaatttttacggggtcagaccatgcacgtcatagcaatccatgttttattcacccatttgttttccatgtccttaaacacagaacactgcatatcgtggggggtttaaaaacatctgttattcgaacgctgcaatgttgcttgctcccgaaatgagtcgacgctgatctgggttggtt

SEQ ID NO: 7569 - DNA, 1410 bp, Zea mays
ggcgctcaacatgggcatcagcaagctcgtcttccccgtctaccgcaacatcatcgcgctctgcctgctcgtgcccttcgcctactttctcgagaagaaggacaggccgcagctgaccctcaacttcgtcgtccagttcttccttctcgcgctctgcggcatcacggcgaaccaagggttctacctgctgggcctggacaacacgtcgccgacgttcgcgtccgccatccagaactcggtcccggccatcaccttcgccatggccgcggcgctgcggatcgagaaggtccggctggaccgccgcgacggcgtggccaaggtggcgggcacgctggcgtgcgtggcgggcgcgtccgtcatcacgctctacaagggccccaccatcttcggtcccagcggcagcggcggcggcggcggcctcgagctggcggcggtgggcggcgacaagaactggacgctggggtgcgtgtacctgatcgggcactgcctgtcgtggtcgggctggctggtgctgcaggcccccgtgctgaagaagtacccggcgcggctgtccgtcacctcctacacctgcttcttcggcgtcatccagttcctcgtcatcgccgccttcatggagagggacgcggaggcctggaagttccactccggatccgagctcttcaccatcctatacgccgggttcatcgcgtccggggtggcgttcgcggtgcagatctggtgcatcgaccgtggggggccggtgttcgtggcggtgtaccagccggtgcagacgctggtggtggccatcatggcgtcgctcaccctgggcgagaagttctacctggggggcatcatcggcgccgtgctcatcgtcgccggcctctacctcgtgctctggggcaagagcgaggagagggcgcgcgtcgccagggacgccgtctccggcggcgaccgcgaggggctccttgtcgcggcagccgccggaggtggtggcggcggcatcatcaggagcgccggcaataaggtggcgtcggccgcgacgcagcctctcctgctgccgtcctccacctccactgacaacgtctgaccgatccatggatggatgaatcgtcatccatgcttgcttggtgcgtggagatctgaggcagcatgcagaattaccagttattagtcatttctttgaggttttcccctgttgattttcacgcatgtatgtatgctgctacctacgtgtacgtacgtatatgcatgcatcactatggttgttttacgcctttgatcacaagacaactacgtagctaggatcgtcggagtgtgttgacgacgtttggtatgtgcatgcgcaatgcagtgcagtgctagctcatcacaggaagtgtgtgtaataatattagtttgcaggtataattatgcgtttgattaagatcgtcc

SEQ ID NO: 7570 - DNA, 2079 bp, Zea mays
ggcgcggcagcgggcaggcagtccatccccatgtgtttgtgactttgtgctcgtcctcatacccccaccccccagctcccgtctcctcgtgctctccactgctgcatgcgcctcttgtcctgtccccctccccaccttgttcctcccatcccgcgccgtctctgcacgaagcagagcgccggtccaccgacaaggacagctacaactacgacgcgcaggcagagccatcgctcatctggggctgccctcggttactcctcccctccgccgctgcccctgccttgtccacagctgttgttaattccttcatgagttggcgtcggcgccagcggggcggaggggaaggaggcggggcttcagcttccccggcgccggccgccgcctgaagatcccttcttctcctgtagtcctgtcgtcgggcgggcgaggtccaagcatcatggggctcttaggtatgatgggcgactcttttggttgctcggcgactggggagcgacttgtgtctgctgcaagagatggagacatccaggaggccagggctctcttagaactcaatccccgccttgctcggtactccacgttcgggatccggaattcgcctctccattactcggcagcaaagggccaccatgagattgtctccctcctaatcgagtccggtgttaatattaaccttagaaattgcagagggcagactgctctgatgcaagcttgtctatatggtcactggaaagttgtacagattctagttctttttaaagctaatattcacaggagagattgttttagcggcgcgaccgctattcattttgccgcgctaaaaggtcatactcgctgcattcggcttcttgtggctgattatgtgcctagcttgtcagagttttggaccattatgcgtggaaagtccacagatgaaatgaaaaagggtgcctttgatgccgcgtctctccagagactagttaatggaaagtctgatggtggtgtcaccccgcttcacttggcagcccttcatggacatgctgagagtgtacagttgctgctagaccttggagcctctgtctctgaggtgactgtcaatgatggttcaacaattgacctcattggttcggggagcacacccctccattacgcggcgtgtggtggaagtgctgtttgctgccaacttctcattgcagcaggagcaaacatgggagctcaaaatgttaacgggttgactcctttattggtggctcgttcgtggcacaagactagcatcgaaggtattctaagcaagcaaccagaaaaccgaatgcgtattcttccttcaccatacctttgcttaccactgatgagcattgtcaaaattgccagggaatgtggatggaggaaaacttccgcctcatccacttgtcaggatccatgtgtcatatgtttggaggtggaatgcactgtagctgcagaaggttgcggccatgagttctgcaccaaatgtgcactctacttgtgctccaccactagcagctcaacatccacccgtggagttcctggctccatatcatgccctctgtgtcgccatgccatcgtctccttcatgaggctcaccagcactaccccgataaaggagcttccatggacaagcgcgtcactagctctatgtgcagcgggctcaaacactggccgccctgaacatggcgggtccttgcatcgaaggcctgacctgcgtcgactgcgctccatctcagttcagctgggatgctcttcttttagatccattggctctgggaagctgtcgtccatgaagctgaactgcacaggagctgaagaggcggtgccttgcctcgtcagctgcctcaggcccgatgtgcagcgttcatcgtcgtacaggggaagaattaggagatattcagagttttgaaaggatggttttgtggcgtccttcctgcgagtttttagggtttgggaatttaaacctgtgtcgtcatgttcctcttcgtttgtttccctgttgtttaatatgcatgcagtcctcgttgtgaagatctatttgtgtacatggcccgtttgtcttcattacttttacttatatgtgaattatatacc

SEQ ID NO: 7571 - DNA, 1268 bp, Zea mays
cagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgacctgctaaatgtgcttgacgttgcattgacatttgtatgagctgagtcgctcattcctttttatgaacgcctgtactcttctcattctctccctgcatttttgtcattcagctggatatttcgaatctggtgtgttttgagatgtattaaagaacgtcaaatagattaccgcctaaaaaaac

SEQ ID NO: 7572 - DNA, 826 bp, Zea mays
ggttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7573 - DNA, 1781 bp, Zea mays
cctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccctccgagcccacccacaccaaggtgaagcagctgctcttctccctcctgctctcccgcaaggacgacgtgatccccaccttccgctccaacttctcctcgctcctcgccaccgtggaggcggagctggccaagggcggcaaggccgagttcaacaagctcaacgacgtcacctccttcgacttcatcggcgaggcctacttcggcgtgcgcccctcggcgaccgagctcggcaagggcgggccgagcaaggcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaataagacttctctctcaccctcggccccaccttcacgtgtgattggaggtgtttgtcgcttttgtaataattataatgcaggatggcatgttgcataaattgctccccaaaaaaaatcttatctttcacaag

SEQ ID NO: 7574 - DNA, 820 bp, Zea mays
atccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgtttggatggcagcgtggccatcagcagcatgcagtcgtcgtcgtagcagagatgtcctagctacgtgtgtgtcatcaggctggcacataataaagaagtagatcatgcacccactagtgatcacttcgtctagtgtccctccgttcgtcgtcgtcgtcgtcgtgtacctcgtacgtgacatgctgtagcacgtactacgctagcagagcagcacctcaatgtccttgggtttgctttgctggctctctgttttcgtcttgtgttgcttttaatctggcacaggtttctaaattataataatgaatacttttttgtcc

SEQ ID NO: 7575 - DNA, 1924 bp, Zea mays
cagaagaagaatccttctcgacgccgcccccattcattcttggagggcaagaagaacgcgcagtccaaaagcgaaacaaggggaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatcctggcaaactctgatgcttttatggtggcaagaggtgatttaggaatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcttatccagagttggcggtgcagactatggctaagatctgcctgcaagcagagtcttgcgtagaccatgctgctattttcaaatcaatcatggcttcagctccaattccaatgagtccattggagagccttgcatcatcagctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccgatcaatccgttgtggccctgcaccgcatcgggatttcatccgtcatcaagcttcttactgtgaagtaggggtccaagggtgagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgcagctgtgctgcaactttatcgtactgaaaattttatgtttgtttc

SEQ ID NO: 7576 - DNA, 1574 bp, Zea mays
gcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttatacggtcgcaataaatgtatggtcgtgtttgctcgagagctactcaggtgattttgtcgtgggagcaccaaaagcagaaaagaacccttttttttc

SEQ ID NO: 7577 - DNA, 2714 bp, Zea mays
ctcctaacctgtcgagctgcccacagcccgtacctacctgcccccagtccccgccgccccgcctgcccgacccgcggcttatccaccacgtccaccgctgggctggatcgatcgggaccggggtcgcgccgccgccgctgccctccgcactcgcgggatcctgttcctaccatgcagcagcgctgcgcccttgcccgaccgcgccggcccgccgaaccgcgcgttccgctccccgacgatcactccctcgtcgccgtcttctccttcctcttcatccccacctaaatcaacctcctcgccgcgaaattctgctacaatttcttcatcttcccttgccgccgggagcggacggatcgccgcttcctcggccggcgggatgagccgggaggcgcagaaactcgactgcaccgccgccggcggcgggatcggggtcctgtcgctggacctgctgggccaggtgctggaacacctgcgggagccccgggaccgcaagacgtgccgcctcgtcagccgcgccttcgagcgcgccgaggccgcgcaccgccgcgcgcttcgggtgctccgacgcgagccgctcccgcgcctgctccgcgcgttcccggcgctcgagcggctcgacctctccgcctgcgcctcgctcgacgacgcctccctcgccgcggccgtcgccgacgccggcggggggctcgccggcctccgcagcgtgtgcctcgcgcgggccaatggtgtcggctggcgcggcctcgaggcgctcgtcgcggcctgccccaagctggcggccgtcgacctgtcgcactgcgtcagcgccggggaccgcgaggccgccgcgttggcggcggcgtccgagcttagggacctgaggctggacaaatgccttgccgtcaccgacatggggctcgccaaggtggctgttgggtgccccaagctggagaagctcagcctcaagtggtgccgtgagatctctgacattggaattgatctgttggccaagaagtgccctgagctccgcagcctcaacatatcctacctcaaggtgggcaatggatcccttggatcaatttcgtcacttgagaggcttgaggaattggcaatggtttgttgttcaggtatagatgacgaaggcttggaattgctgagcaaggggagcgattcgctgcagagtgttgatgtgtcaagatgtgatcatgtgacttccgaggggttagcttcactcatagatggtcgcaattttcttcagaagttatatgctgcagattgtttgcatgagataggacagcgttttctatccaagttggcaagactgaaggaaaccttgacgttgctgaaactcgacggtcttgaggtctcggactctcttcttcaagccattggtgaaagctgtaacaaattggttgagattgggcttagcaaatgcagtggtgttacagatggaggaatctcatctcttgtagctcggtgtagtgacctaagaacaattgatctcacatgctgcaatctcattaccaacaatgcgcttgattcaatagctgacaactgtaagatgcttgaatgtttgcggttggaatcatgctctttgataaatgagaagggactaaagcgaattgcaacttgttgccccaaccttaaggagatagacctcactgactgcggagtggatgacgcagcattgcagcacttggctaaatgctctgaattgcgaatattgaaattaggcctatgctcaagtatttctgacagaggcattgcatttatcagttctaattgtggaaagctcgtggagcttgatctctaccggtgcaactctattactgatgatggattggcagctttagcaaatggatgcaagaggattaagttactgaacttgtgttactgcaacaagatcactgatactggtttaggtcacttaggctccctggaggagctcacaaaccttgaactgaggtgcttggtccgcgttacaggcattgggatctcctcagttgcaatcggatgcaagaacctgatagagctggacttgaaacgatgctattcggttgatgacgctggactgtgggcccttgctcgttatgctttgaaccttagacagcttacgatttcgtactgccaagtcacggggttgggcctgtgccacctgctgagctccctgcgatgcctccaggacattaagatggtgcacctctcatgggtatcaatagaagggtttgagatggctctgcgagcagcctgcgggaggctgaagaagctgaagatgctctgcgggctgaagaccgtgctctcccctgagctcctccagatgctgcaggcttgtggctgccgaataagatgggtcaacaagcctcttgtctacaaggactagacagactcgtgttcctcattgtgtgtgcagtgtcagcatcagcatgtattgtcaagatcttgcaggtttgccctggctcacgttgtgagtccgcaataatcgttgggggcgtaagctcccgtccccaagatgtggttatggtgcctttggggcacttcttgcgccatttgtcactctctgctccggtgtatctgtgtatgcaaacggaggcaccggtaatgttcatgtgtatatagcgtgcagtagaatgatcccattttatgggattagttagtgtgtaattgttacctcatttcgcatgattcgaatcttgagatgaaagaatcataaggggtatgatcgatgcattgcattc

SEQ ID NO: 7578 - DNA, 1945 bp, Zea mays
cacactttgtcagtttgccgtcgctgtcggcgccgccgcctgtcctaatctcctctgagtccagcggccacctcctccaccgggagctccccgtaccataaccgcagtccgcagccattggaatttccgcttcatgcgtggatcctcgtagaccccgacccgcgtgcactcaatccctaggcggcggcctccggcgcgaggctagcgggcggcacccatggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaagactgccagagtaatgaagaagaaaatgataccgttgcgaggttgatgtttgagctgtgggacaggattatctgcatgtacattctgttgcagagatacttagcgctgcatggatctgtcactgaaatattattcgataattggtagctagagccttcttttgccctagctttgataaaaggggcctggggaagggataaaccgaggcaagcctcctccctgctgctaaaaattaggatcttccagatttattgccatttaactagagtatttttttgtgagggccatttaactagagcagaacacctcatcatgttgctaaagttatgaaaacttttggagacatggacttccacctgttcgaagatgcataattgcatatatttggattttgcggtgattcttggaaattcagcacttcagctatctgtgtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggtgaattcccatcagggcatacagctgatgttcaaagtgtgtccatcaactcatcaaatacaaatatgtttgtctctggctcatgtgatacaactgtgaggctgtgggatatcagaattgcaagtcgagctgttcgaacctaccatggacatgaggatgatgttaacagtgtgaagtttttccctgatggccataggtttggtactggctcagatgatggcacatgtagattatttgatatgagaacagggcatcaacttcaggtgtacagtagggagcctgatagaaatagtaatgaactacctactgttacatctattgcattttcaatatcaggaaggctactttttgctggttactccaatggtgactgttatgtgtgggacacacttctcgccgaggtggtacttaatttgggaaacctgcaaaactcccatgatggccgtataagttgcctcgggatgtcatctgatgggagtgcattgtgtacaggaagctgggacaaaaatttgaagatttgggccttcagtggacaccggaagatagtttgaaggccaacttttctcccccatgttgtatgttccttgttgccccttaacaacggacagtggtgattggtgaccaactcgacttgttcctgggaatccctttgttgttttgtaagctctgttcgcgctatgtttaatggaaaaatgtgcaatttgtc

SEQ ID NO: 7579 - DNA, 2137 bp, Zea mays
accacacctgcagaaatcacagcggcaggtgcagcaaaaatctccatgcccccgctcggctagatctccgacgagccggccccgcgctgtagcagattcgctccccgatcccgaccgatgggcggtgaggtgccggagccgcgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccacgcgccgccatgtacgggctcatccccgaagactttggcgcctacgcggcgccctgggtcgccgagctcgccgcgccccttgactgcctcaaggcgctccacctgcgtcgcatgaccgtcaccgacgaggacatcgccgtgctcgtccacgcgcgcggccacatgctacaggcgctcaagctcgacaagtgctccggcttctcaacagacgccctccgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgtactagtgaatctaatcctaggaggttgttgccctgtgctttcttttccccggaattgtatctttgctccactgtaaatatcagaaatggcctgtgctagatgagttgaat

SEQ ID NO: 7580 - DNA, 869 bp, Zea mays
atcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacatagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgaggacgagcacatcaagcagtacaagtgcccgtcctgcaccggcggcggtggcgtcagcaacagcggcaccaagcgagcccgcccatcatagctgcgacttttagtgatgtaaactgcttagaaaaactgttgcggacatagcgcccatcatagctgcgactttttaaatggtgctgtaaacttttgtagtgcgactaggccgtttgtcaccctatcatacttggcttcaagtaggttttttgtttttc

SEQ ID NO: 7581 - DNA, 1049 bp, Zea mays
gctagctagttctatagctgctgtcgtcgtcgtcatcggcggcggcggcgcctgttcttagaggataaggttgtcctagcggagagggagctagccaggatttcggttgagatcaagagggggagcaggcggcggcggcggctgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagcagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagaaccaacttatgctcgagtcaatttcggagctccaacagaaggagaagtcgctgcaggaggagaacaaggttctgcagaaggagctcgcggagaagcagaaagcccagcggaagcaagtgcaatggggccaaacccaacagcagaccagttcgtcttcctcgtgcttcgtgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttcccgtttatccgcctggtgcagtatagtatcatcgtgatcgcgagagcagcagcagtgggtttgccgtatctttttttaccaatgtatgtctatatatgtaagtatcaaatctgcaatgtgttaatcaccatttccgctggggcggccgc

SEQ ID NO: 7582 - DNA, 1806 bp, Zea mays
ctgcatttgcttggctgctgctcccttctcccaccgaccaactcgatcccgcgccatggatcgcgccgaccccgcgcggggccgccttgccgtgctctcctcccacctccgtggtgcaggggccgaggaggcggcggggctggagaggtcgccggtatccgcgccggcgcccgggccccgcgccggcgcgcttgccgtggtggacgggaggaccgggaagcggcacgaggtcaaggtctccgaagacggcaccgtgcgcgccaccgacttcaagaagattaccactggaaaggacgacaagggtcttaagatttatgatcctggttaccttaacactgcccctgttcgctcgtccatctgctacatcgatggagatgagggaatccttcgctataggggttatccaatcgaagaattggctgaaagcagctcgtttgttgaggtggcctaccttttaatgtatgggaacttgcctactcagagtcaattggcaggctgggaatttgctatttctcagcattctgctgttccccaaggactgttggatatcatacaatcaatgccccatgatgctcaccccatgggtgttcttgccagtgcaatgagcaccctttctgtctttcatccagatgcaaaccctgctctacaaggtcaagatctttataaatcgaagcaggtgagggataaacaaattgtgcgagtacttgggaaggcaccaacaatagcagctgctgcctacttgagattagcaggaagacctcccgtccttcctttaaatactctatcttattcagagaacttcttgtacatgctggactctttgggtgacagaacatataaaccaaatcctcgacttgctcgagctctagatattctttttattctgcatgctgaacatgaaatgaactgctccactgctgctgttaggcaccttgcttcaagtggtgtggatgtatttactgctctttctggtggtgttggagctctatatggtcctctgcatggcggcgcaaacgaggcagtacttaaaatgttaaatgagattggaagcatggaaaatattccagatttcattgtaggagtgaagaacaggaagaggaagatgtccggttttgggcaccgtgtgtataaaaactatgaccctcgtgctaaagtcataaggaaattggcagatgaggtgttctcaattgttggacgggatccacttattgaggtggccattgccctagaaaaggcagccctgtcagacgaatattttatcaagaggaagctgtatccaaatgtggatttctactctgggctaatttatagggcaatgggattccctacagaattttttcctgtgctgtttgctattcctcgcatgggtggctggctagcgcattggaaagagtcactcgatgatcctgacactaagattataaggccccaacaggtatacaccggcttctggcttaggcactatacccccgtcagagaacgagtgctatcaagccagagtgaggaacttggtcaggttgccacctcaaacgcaactaggcgccgccgtgctggttctgccctgtagaagctgcagcgtataaacgcaccggcatactcaataaacatcgaccacttttgtgcttgaaaaggccacaaatgctttttagcttggttggagttgtaggccttttgttgtcgagtatataggcaataatgcagtgagaacaccacaccgttacaatgtaaaactgtcacgaggcatcacttgctggtgtacaccccttgcgttctctatgacttaatcacttaacttcccaaaagatg

SEQ ID NO: 7583 - DNA, 1479 bp, Zea mays
cgcctcgccttcccttccccaccagcccccgtctctctctctctctctctgtctctctctcgtagccgcgtccatctcgcagcagcaagcaagcgcgaccaaatggcgcctctaggagacggcggagctgctgccgcggcggcgtccaacaacctggtggtgtcgttcggcgagatgctgatcgacttcgtccccgacgtggccgggctgtcgctggccgagtcgggcggcttcgtcaaggcacccggcggcgcgcccgccaacgtcgcctgcgccatcgccaagctcggcggatcctccgccttcgtaggcaagttcggcgacgacgagttcgggcacatgctggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggcggcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggccctcaagttctccaacgcctgcggcgccatctgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatccttttttttattttattttattttatttttagcttggatcagttggggttttgaacattgctagtgtcgtgtgattgggaaggctaatgtgatgccttcgatgcagagttttcaatgaatgccttggtgcaaacgtacgattgtgtaat

SEQ ID NO: 7584 - DNA, 1916 bp, Zea mays
cccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagatggcggaaatggagtgatttctatgtgtggttagctgtctgtcgacttgttttgccacagtttgggtgcttaaacgttaacgtacgtactagttcaatatagtgtctcgggggcgaattggttgtttacatgtcatgtgtttatatatgcgcaatgttcgatctcagtggaataagtcaagtgctcttatgaatcaaaaggtgttgaggatttgatgcgtc

SEQ ID NO: 7585 - DNA, 1063 bp, Zea mays
gggttgcccaatggatgcttcaaattcctggtgcatcaagttacataggttgcatcgggaaggataagtttggtgaggagatgaaaaaaaatgcacaagctgctggtattaatgcccattatcatgaggatgataatgctccaacgggcacatgtgctgtttgtgttgttggtggagaaaggtcacttattgctaacttgtctgcggcaaactgctataagtctgaacatctgaagaaacctgagaattgggcacttgttgagaaggcaaaatatatttacattgctggatttttccttacggtatccccggattctattcaacttgttgctgagcatgccgctgcaactaacaaggtgtttatgatgaacctttccgctccctttatctgcgaggttttccgtgatgcccaagagaaagctcttccgtacgtggattacatctttggaaatgaaactgaggcgaggacctttgctaaagttcgaggttgggagattgagaatgttgaggagatcgctttgaagatctcccaattaccgaaggcttcaggaacacacaagaggattactgttatcactcaaggttgcgatccggtagttgtggctgatgatggaaaggtgaaaactttccctgtgatcctcttgcctaaggagaagcttgttgacaccaatggtgcaggtgatgcgttcgttggaggcttcctgtcccagttggtacaagagaagagcatcgatgagtgtgtcagagctgcctgttacgccgccaatgttgtcatccaacgttctggctgcacttaccctgagaagcctgacttcaactagagccatttcagaatttagagtcttatggcatctggtctgtataattagtcgggttcgccttggtctgtttacggcacattctagtgtcaccgtacaggtcaaatgttcatgcgtgtaaggcgtgtcatactgtcatggcactctacaagtgcatgtgccagaaacgtgcatgcgtctctcggttacggactctttacagttgcatctaaaacaattcaaagcaccttgcggtgcatccttga

SEQ ID NO: 7586 - DNA, 2075 bp, Zea mays
gcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagatggcggaaatggagtgatttctatgtgtggttagctgtctgtcgacttgttttgccacagtttgggtgcttaaacgttaacgtacgtactagttcaatatagtgtctcgggggcgaattggttgttt

SEQ ID NO: 7587 - DNA, 736 bp, Zea mays
cctcgttcccaatcatcttgccgcgcgccgcacgtagctagggtttcgtcctgtcgttgcacccgcattactagcattcaatccacgccaatggctgagaagaagatggttacgctcaggagctccgaccacgaggagttcgaggttgaggaggcggtggcgatgaagtcagagatcatccgtctcttgatcgaggacgactgcgccgacaacgccatcccgcttcccaacgtggattccaagactctcgccctggtcatcgagtactgcaacaagcacgtccacgccgccgccgccgacgactccgccgccgcggagaccagcaacgcctcatcagctgcgggcggcggcgacgtcgacctcaagaagtgggacgcggagttcgtcaaggtcgagcaggcgacgctcttcgacctcatcctggctgccaactatctcgacatcaaggggttgctggacctgacctgccagacggtggccgacatgatgaagggcaagtcaccggaggagatccgcaggacattcaacatcaagaacgacttcaccgaagaggaggaggaggagatccgcagggagaactcctgggccttcgactgatgtagtctccccgtccgcggacctagctcggtggttattactgttagattcgatctctagtgctagtttgttcgtctgcacttatcttctgatctgaaacattaataagtagttcgtttgtctacagttaccagttgat

SEQ ID NO: 7588 - DNA, 890 bp, Zea mays
cgtacgaggttctgaattgacacaccggctaatgcatgcatgggtgtacgcttttgtcttttgctcggagacgacggagaggcagaagctttactggatctggaggattagcgcttcacagggatcgccatgtcggactcggaggagcaccacttcgaatcgaatgccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgaattatctgtggttacattctggaccctgtattttctatgcttttatgcccctactgtttagtattaattatcaataaatttgtttgggacggttgaattgcatgcattgcatgaggtttcttgttcgtt

SEQ ID NO: 7589 - DNA, 1629 bp, Zea mays
gagcttgaatatagtccccctcctctctctctcacacacctgttcttcgatctcggcctagctagctagctagcgagcaagctatagcttagctcggctagccgggtgtgtcgccggtcggctaggcaacgccgctagcgatcgcaaaatggcagatgcgggggaggggcggcgggtgtgcggcatgccggagaaggcgcagctgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgctctgcggcatcacggcgaaccaagggttttacctcctgggcctggacaacacgtcgccgacgttcgcgtccgccatccagaactcggtcccggccatcaccttcgccatggccgcggcgctgcggatcgagaaggtccggctggaccgccgcgacggcgtagccaaggtggcgggcacgctggcgtgcgtggcgggggcatccgtcatcacgctctacaagggccccaccatcttcggtcccggcggcggcggcggcctcgagctggcgtcaaccagcaaggcggtggccggcgacaagaactggacgctgggttgcgtgtacctgatcgggcactgcctgtcgtggtccggctggctggtgctgcaggctcccgtgctgaagaagtacccggcacggctgtccgtcacctcctacacctgcttcttcggcgtcatccagttcctcatcatcgccgccttcatggagagggacgccgacgcatggaagttccactccggatccgagctcttcaccatcctatatgccgggttcatcgcgtccggggtggcgttcgcggtgcagatctggtgcatcgaccgcgggggcccggtgttcgtggcggtataccagccggtgcagacgctggtggtggccatcatggcgtcgctcaccatgggcgagaagttctacctgggcggcatcatcggcgccgtgctcatcatcgccggcctgtacctcgtgctctggggcaagagcgaggagagggcgcgcttcgccagggacgccgccaccctcgtctccggcagcggcgaccgcgaggggctccttccggccggcggcggtggcatccggagcgccagcaaggcggcagcgtcggccgccacgcagcctctcttgctgccgtcctccacctccaccgacaatgtctgatcggtcgacctatgaatccttcgtcgtcatccattgaccatggtgcgtggagataagagactgcatgcgtacgatccatgaggcgctgccatgcatgctgcgcgctctggtgcactcatggattggagcagtatgatccgatccagcagtaataattatcatcagctagtcttttttttgtggtttttccttgttgatttcacgcatgtatgtatgctgcaacctacatatatgcattactatggtgtgtgtgtggtgagagcagacgacggcaaggtttattttaacttcgatcacgacct

SEQ ID NO: 7590 - DNA, 2700 bp, Zea mays
gcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccaggtagtatgttagcaccacagaaggtagaagaaaggagatcagagattagagctaggaagacggaaggaagacgagagctagacggggtctaagtaaattggtattttgtatttcgttgtttgatgccttttacagctgactcagcctatatttatatctcctcaagcccacataacccatagctcatctactacacctaatatatctaacatagtactacaactaataaatctcttataagcttgactagatctataaaaaaaatagcattggtgtttatacatctttactataaaattacattattctatagttaattcaattattgcataataaatattagtaatcttgttatatatttgatcgaacttttattgtgaatcacagagaataagttttctattctacttgggaaaaccatatatgagcaatgccaaaagttctcgagtttttcgaccggaaaatcctgaatatacctgataaacaatgaacatatatggacgacctgaagagaaaaaaaaaagttcgattgttttgtgtttcccagttcagactaataagttacagtaacagatggtttgtagagatgtttaacttgtctctgccaaacaataactacgacctgtttatacactcctgttatgttacttgccactgtgcatttgcttactgcctgccctctattcctgcagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgcctaggcttcgaggtactactgttcttcgatcggttcttcctcctcttgatcgaacattctgaatatatatgtgcaggggaacaaaagggggtgctgtctgatacgtttcttgagggcgagtcgtttttgtttctgttctcgctttgtgctgccgtaacagcctcccaatctggtcgggttttttttttttggtgccgcttctatctggtgtgtaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgcgtcgtcgtcagggaggacttcagccgcagcctcgccgagcggctggtctcggacgtccgcaagatcctgcgcgagctggacgcgcgcgcgacccacgccgtgagggtctccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgtatgttgggtgtggagtatatttcttcgccaggtatttgctgtaatcctgtccctttacgttcgtgcactgcaatgagaataaaaaaaaataagtgtcgttcacgg

SEQ ID NO: 7591 - DNA, 2592 bp, Zea mays
gcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgctctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaaggttgtccgccagaacctaagggtgaggcttggtgatgtggtttctgtccaccagtgccaggatgtgaaatatgggaagcgtgtccacattcttccaattgatgatacagttgaaggcattacagggaacctgtttgatgccttcttgaaaccatatttcctagaagcatacaggccgttgaggaaaggagaccttttccttgtcagaggaggaatgagaagtgtggaattcaaagtgatagagactgatcctgctgaatattgtatcgttgcgccagatactgaaatattttgtgatggggagcctattaagagggaggatgaggagcgtcttgatgaagttggttatgatgatgttggtggagttagaaagcaaatggcccaaatcagagagcttgttgagcttccactacgccatcctcagcttttcaaatctattggtgtgaagccaccaaagggcatattgctgtacgggccacctggttcgggaaagactcttattgctcgtgctgttgcaaatgagactggagcctttttcttcctgatcaatggtccagagattatgtcaaagctggcaggggagagtgaaagcaatctcagaaaggcatttgaagaagcagagaagaatgctccatctatcattttcattgatgaaattgattccattgcacccaagagagagaagaccaatggagaagtagagcgtcgtattgtttcacagctactgactcttatggatggactgaaatctcgttcccatgttattgttatgggtgctacaaaccgaccaaacagcattgatcctgctcttcgaagatttggaaggtttgatcgggaaattgacattggagttcctgatgaagttggccgtctcgaggttctccgcattcacactaagaacatgaaactagctgaagatgttaatttggaactcatttcaaaagatacccatggatatgttggtgctgatcttgctgccctttgcactgaggctgctcttcagtgcattcgtgagaagatggacatcatagatcttgaggatgagacaatcgatgcagagatattgaactcaatggctgttacaaatgaccatttcaagactgcgcttggaacaagcaacccatctgctcttcgtgaaactgttgtcgaagtcccaaatgtctcttgggaggatattggtgggctggagaatgtcaagagggagctccaggagactgttcaatatcctgtggagcatccggagaagttcgagaagtttggcatgtctccatccaaaggagttttgttctatggtcctcctggttgcggtaagaccttgttggcaaaggcaattgccaacgagtgccaggctaacttcatcagtgtcaagggtcctgagttgcttaccatgtggtttggtgagagcgaagccaacgtccgtgaaatttttgacaaggctcgtcaatctgctccttgtgtcctcttctttgatgagcttgactcaattgctactcagagaggaagcagtgtgggtgatgctggaggtgcggctgatagagtgcttaatcagctactgacagaaatggatggcatgaatgccaagaaaactgtgtttattattggagctacaaacaggcctgacatcattgaccctgctctgctgaggccagggcgtcttgaccagctgatctacattccactgcctgatgagcagtctaggctccagatcttcaaggcctgccttaggaagtcccctgtggcgaaggatgtggacttgaatgctcttgctaagtacacgcaagggttcagtggagcagatatcacagaaatttgccagcgtgcgtgcaaatatgcaatcagagagaacattgagaaggatattgagagggaaaggcggagaaaggacaaccctgaggcgatggaggaagatgaagtggatgagatcgccgagatcagggcccctcacttcgaggagtcgatgaagtatgctcggcgtagtgtcagtgatgctgatatccgcaagtaccaggcgtttgcccagactttgcagcagtcccgggggtttggcagtgagttccgcttctcggatcagccggcgacagctggtgctgctgctgcagccgatccgtttgcttctgcgggtgctgcggctgatgacgacgatctatacagctagttgggttgctcaatatcagtcccgtcactcatctgtttaaaactgatcatactaaacacgcatgtcatgcaatgatatttatttgccgt

SEQ ID NO: 7592 - DNA, 1290 bp, Zea mays
cgccaccatccaatcgaagctctggaacctcctccactcccagcttccgccgacgctcgcttcagctgctgctttccttcccatccttcaacaggtgcaatttgcatttcccatggagctcactgattaataacgtgtgagctgaacttgcttttctgtggacaatttggaacttcagtactagtttccgataggattcagggagaaatgatctcttttaacaatttattttggagctcccttcagccttctttcaagttttacagaaagtgcctgacaaactgcccatattttgcactgaccatgcattcaactacaaagcccttgggttcatctatgccggtaaagagggcgcatttgaagccacatgccgcagacatcaagaggaacccccatgtacatgagctttacaaattggtttaccgacttccggagaaccttagctggctgttggcaccaccagaaattcctaaaagacctgcctcaaagaagaaaaaacaaaaagacgaaatagtggccggtaacagctttggtgtgatcttggagtgggagggagttgttgtggatgatgatgatccagacttggagccccgggtttggtatgttctatcactagaagaggggaagtctttccctccagatgcattgctgaagaaaatcgagggaatgagaactgaccaggctattgcagaagtcttatgttggtcagaagatccagcagaaatccaaaggttggcaacacacaaggaggttatatatcaaaaacttcaaggtggatactaccagctgcgaccacatgtgcttgatttcttgaacacccttgtgggttttgacattccaatagcaattgcagctcctcgctcaaggaagagccttgaagaagggatcaaaactgttggtctgcaaggctacttcgatgctatagttgcattggaggacttctgcttagggaaacctgatggtgagatgtttgaagtcgcagcggagcaacttggtctggaaccagatgcctgtgttgtgtttggtaactcaaacttgacgacggaatctgcacataacgctgggatgaggtgtgtggcagttgcaggccgacaccctgcctatgagctccaatcagcaaaccatgttgtgagatggcttgatcagctctctattgttgacttgcagaggcttgctaatggtgaagttattggtcgcaggggtagagaatctgacatggatatggaaattgtgattgaggaatgatgatgtttctgcaaaaatgacgcactaatatattgttgtgcttat

SEQ ID NO: 7593 - DNA, 2230 bp, Zea mays
cgtctgtccgctacccctccccgaccagatcgctacgagacgccgcgcgatccgacccaggccgacgccgacgacccctctcgccgccggcggccatggcgtacggcgaccgcgtcaccaccttcgaggactccgagaaggagagcgagtacggctatgtccgcaaggtctctggacctgtggttgtggctgatggaatgggtggtgctgccatgtatgaacttgttcgtgtcggacatgataacctcattggggaaattatccgtcttgagggcgattcagctacaatccaagtttatgaggaaacagctggactgatggttaatgaccctgtattgagaacaagaaagcctctttcagttgaattgggacctggaattcttggaaacatttttgacggtatccagcgacctctaaaaaccatcgctattaagtcaggagatgtgtatattcctcgtggtgtttcagttcctgcccttgacaaagatgtattgtgggaatttcagccaacgaagctaggtgttggagatgtcatcacaggtggagatctatacgctactgtttttgagaacacattgatgcagcaccatgttgctcttccaccgggttctatggggaaaataagttacattgcaccagctggccagtacaacctgcaggacacagtgctagaattggaatttcagggcataaaaaagaaatttaccatgcttcagacatggcctgtgcgttcaccaaggcctgttgcatcgaagcttgctgcggatacacctcttctgacagggcagcgtgtactggatgcactattcccctcggttctgggaggcacttgtgctattccaggagcatttggctgtggtaaaactgtcattagtcaggcactttccaagtactccaattccgaagctgtggtttatgtgggctgtggtgaacgaggaaacgagatggctgaggttctcatggactttccccagttgacgatgacattgcctgatggccgtgaggagtctgtcatgaagagaacaacactggtggctaacacatcaaacatgcctgtcgctgctcgtgaagcttccatttacactggaattacaattgctgagtatttccgtgatatgggctacaacgtcagtatgatggctgactccacctcccggtgggctgaggcattgcgtgagatctcagggcgtttggctgaaatgcctgctgatagtggttacccagcttacttggctgcacgtttggcatccttttatgaacgtgctggtaaggtaaaatgtctgggaagtccagacaggaatggcagtgtcacaattgttggagctgtctctcctcctggtggtgatttttcagaccctgttacctccgcaaccctcagtattgttcaggtcttctggggtttagataaaaagctcgctcaaaggaagcatttcccatctgtgaattggctcatttcctattcgaaatactccaaggcccttgagtctttttacgagaaatttgatccagatttcattgatattaggacaaaagcacgtgaggtgttgcagagggaggacgatctgaatgaaattgtgcagcttgttggtaaagatgcgctggcagaatctgacaagattacgctggagacagcaaagcttttgagagaagattatttggcacaaaatgcattcaccccatatgataagttctgcccattctacaaatccgtttggatgatgcgcaacattattcacttcaacacattggcaaatcaggctgtggagcgggcagctggtactgacggccataagataacatacagtgtcataaagcatcggttgggggatctattttatcgcctagtatcccaaaagttcgaggatcctgcagaaggcgaagaagctttggtcggcaagtttaagaaactgtacgacgaccttaccactgggttccgcaacctagaagatgaggcacggtgaactgctgtagattttgtgtaagacaataatggctgccaaatggtttataaggtacggaagttgtagattgagaccatgtatgagaattttccccaccgctactcatttctttgccaccactattttagtcatcagtgctggatgggcaccctgtttatttcgacgtaccctttattgctagcattgtaataagcgatgggcatgcttgtagttgaataagtacaatgtccatgtattcaaacatcagcgtcatgtttatttgtttgttg

SEQ ID NO: 7594 - DNA, 828 bp, Zea mays
agctggcaggcacatgacacatcgccccagccccaagtccaaagccgcgagaggcaggggcgcagcaaaaccctagccgccttcccgtccttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggcggctatggtggcggcggctatggaggtggtggctacggaggtggtggcggctacggaggtggtggctatggtggtggcagccaaagctatgatgcttgaggggggcaggatcctattaagtgcattatcaaccaagatatttgaaataatgaactttaggacttggtatgacgttttatgttaagcattgtcaggttttgctattcgtgttatgctgaattgttggaactcctagatgcagaatattacgtattggttttggttc

SEQ ID NO: 7595 - DNA, 2247 bp, Zea mays
gcggaaaacctcagaaaaccacaataaatcatcctcgtccaccactgcccccgctctgctgcaactccactcggcccggccgccctttccacccaccttgatcctctgatccgttggtgcttgaccgatccatggacacccatatcggatccgtgaacggggcggcgtcgaaccagacggttggctgcccggcgtcggcgccggggtgcccgatggcgtccacgccggcgcagcccgcggcgaccctgtcggcgggggaggcgtcgctggggcgccacctcgcgcgtcgcctcgtgcaggtcggcgtcaacgatgtattcgcggttccgggggacttcaacctcacgctgctcgaccacctgatcgccgagcccggcctgcgcctcgtcggctgctgcaacgagctcaacgccgggtacgccgccgacgggtacgcgcgcgcgcgcggcgtcggggcctgcgccgtcacgttcacagtcggggggctcagcgtgctcaacgccatcgcgggcgcctacagcgagaacctgcccgtcatctgcatcgccggcgggcccaactccaacgactacgggaccaaccgcatcctccaccacaccatcggcctccccgacttctcgcaggagctccgctgcttccagaccgtcacctgccatcaggcggtggtgaacaatctggatgacgcgcacgagcagatcgacacggccattgccacggcactgagggagagcaagcccgtgtacctcagcatcagctgcaacctccctgggctgcctcatcctaccttcagccgcgacccagtgcccttcttcctcacccccaggacgagcaacaagatggggctagaggctgcagtggaggcaactgtcgaattcctgaacaaggcggtgaagccagtccttgtcgccggccccaaactgcgtgtggcaaaggcaggaaaggcatttgtcgatatggtagatgccagtggctatgcctatgccgtgatgccatcggccaagggtcttgtgccagagacgcacccccacttcatcggcacctactggggcgcagtcagcaccgccttctgtgccgagattgttgagtccgcagatgcctacctctttacaggccccattttcaatgactacagctctgttggctactcattcctcctcaagaaggaaaaggccatcatcgtccagcctgagcgtgtgatagtggggaatgggccggcattcggatgtgtgatgatgaaagagttcttgtctgaattggctaagagggttaataagaacaccactgcctatgagaattacaagaggatctttgtacctgagggacagccgctggaaagcgagccaaatgagccactgcgagtgaatgtgctcttcaagcacgtccagaagatgttgactggtgatagtgcggtgattgctgagactggtgactcctggttcaactgccagaagcttaagctgccagaaggctgtgggtatgaattccaaatgcagtatggttcgattggatggtcagtgggtgcattgctcggatatgctcagggtgcgaaccacaagcgtgtgattgccttcattggtgatgggagcttccaggttacagcacaggatgtgtcaactatgctgcgatgtgagcagaacagcataatcttcctgatcaacaacggtgggtacacgattgaggtggaaatccatgacgggccatacaacgtcatcaagaactggaactacactggctttgtggacgccatccacaatggcgagggcaagtgctggacctccaaggtgaagagcgaggaggagctgacggctgctattgagacagcgctaggggagaagaaggactgcctgtgcttcatcgaggtgatcgcgcacaaggacgacaccagcaaagagctgctggaatggggctctagggtttctgccgccaactcccggccaccaaatcctcagtagaagtcccgcaggctccaagcctcggagtgccagtagtgatagtaagctgtagcacggtgggggctcaactgaataacgtgaacgcattgccctttctgttacgtgttttattttattgtgtttctgtggtcgtatatctgttttgtgacgtgtcccttgcttctcccatgtgaattccagaagaactatgagaaatttcaggttggtgatcactcatctgtgttgtcactatttgtgctgcgttaccggtgtgattttactgatcaggtaaacatcgccggccagggagtgaatc

SEQ ID NO: 7596 - DNA, 1295 bp, Zea mays
cgaactcgagacctcgcccgcccaaatacgaaagcctcagatctcagtgaccagcgccgccgcttcgttcgtgtcgaggggagaagaggaaatggcggcgagcgagggcgtgctcctggggatgggcaaccccctcctcgacatctccgccgttgtcgatgacgccttcctagcaaagtatgacatcaagctgaacaatgccattctcgctgaggagaagcacttgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggtgaaaggtcattgattgcaaatctgtcggcggcaaactgttacaaatctgagcatctcaagagaccagagaactgggcactagttgagaaggcaaaatacatctacattgctggatttttccttacggtgtcacctgattctatccagttagttgctgagcatgctgcaacaaataacaaggtgttcctcatgaacctctctgctcccttcatctgtgagtttttctgtgatgcccaagagaaggtcctcccgtatgctgacttcatcttcggcaatgaaaccgaggcaaaaatcttcgccaaagttcgaggatgggagacagagaatgtcgaggagattgctttgaagatctctcagcttcctttggcttcaggcaagcaaaagaggactgctgtgattactcaaggcgctgatccagtggttgttgctgaggatgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgccgccaatgttatcatccagcgcccaggttgtacctacccagagaagcctgacttcaactagtgcaatactcaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatgcttgc

SEQ ID NO: 7597 - DNA, 1546 bp, Zea mays
gttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttt

SEQ ID NO: 7598 - DNA, 1101 bp, Zea mays
caaattcttgatgttgtcacattaagcacccatgagacggggagaaacgtagtggactcctaatttttatggccaggtatgacgaattggctagcaagagcaatgttgaatacattgctggaggagccactcaaaactctatcagggttgcccaatggatgcttcaaattcctggtgcatcaagttacattggttgcatcgggaaggataagtttggtgaggagatgaaaaaaaatgcacaagctgctggtattaatgcccattatcatgaggatgagaatgctccaacgggcacatgtgctgtttgtgttgttggtggagaaaggtcacttattgctaacttgtctgcggcaaactgctataagtctgaacatctgaagaaacctgagaattgggcacttgttgagaaggcaaaatatatttacattgctggatttttccttacggtatccccggattctattcaacttgttgctgagcatgccgctgcaactaacaaggtgtttatgatgaacctttctgctccctttatatgcgaggttttccgtgatgcccaagagaaagctcttccgtacgtggattacatctttggaaatgaaactgaggcgaggacctttgctaaagttcgcggttgggagaccgagaatgttgaggagatcgctttgaagatctcccaattaccgaaggcttcaggaacacacaagaagattactgttatcactcaaggttgcgatccggtagttgtggccgatgatggaaaggtgaaaactttccctgtgatcctcttgcctaaggagaagcttgttgacaccaatggtgcaggtgatgcgttcgttggtggcttcctgtcccagttggtacaagagaagaacatcgatgagtgtgtcagagctgcctgttacgccgccaatgttgtcatccaacgttctggctgcacttaccctgagaagcctgacttcaactagagccatttcagaatttagaatctattggcatctggtctgtataattagtcgggttcgccttggtctgtttgcggcacattctagtgcccccgtacaggtcaaatgttcatgcgtgtaaggcgtgtcatggcactct

SEQ ID NO: 7599 - DNA, 1636 bp, Zea mays
cgcacgcaaagcacggacgggcgcatacagctttccctttcgcgagtgcgtgccccttctcttctctagttctcttctccgtcgcgtcagagatcagggagagaccagagcaaacaacaaccaccgcttgtttcatcaagaatcgtggaggagaaccgaaaggtgtagtagccttttccggtagggcatctgctagagccggccggttgaagcaggggagcgagaggaggagggcagccgagcaggagcatcgcagtggtggttaagcagcagcaacgacgacgacgacgacgctgagaggtttccccgttcccgacggcacgtccaccgaggcggcgccatcgcgatgggtcctctggcgccgctgaggtgtaacccgccgccgccgttctccaagtcgccggggtccctgctgctgctgtccaagtcgctcaccctctactgctgagccgagccccctcctcgatcggttccatgggcgccgtggcctcgtcggcgggtggggcccggggaggcgatggcacggtgctgggcgacctgccggagaactgcgtcgcggaggtgctgctcaggctggacccgctggagatctgccggatggcgcggctcagccgcacgttccgtggcgccgcgtccggggacggtgtctgggagtccaagctaccgaggaactacgcgcgcctcctcgccgttgctgcggccggcgatggggaaggtgggcaggccgccgcgtcggcgccgggggcagagctgctgcccaagaaggaactgtacgcgcggctttgccgtcggaaccgtttcgacggcggcaaaaaggagttctggctggacaagggcggtggaggtctatgtatgtcaatttcttcaagggcgctttcaataacaggcattgatgataggaggtattggaacttcattcccagtgatgaatcaagattccgcacggttgcgtacctctcgcaaatctggtggtttgaagtgagaggggaggttgaattcttcttcccagaaggcacgtacagcctattctaccgcattcatctcggccgaccattcaagcgtcttggccggcgagtctacagctcggagcacgtccacggctgggacatgaagccggtgcgtttccagatgtcgacctccgacggacagcatgttcagtccaagtgctacttgagcgatcccggtatctggatcaaccaccatgtcggggacttcgtcgtgaaggactcgagcaggccagtgaacatcaggttcgcgatgattcagatagactgcacgcacacgaaaggcggcctctgcgtggattcggtcgtggtgaaacctcagcacctctcgcagaaaaaaagcgccctggacttacgtgtagactcgtcgaacaagttgctgctgctgtctagggaggagggatatgatccatagtttccttttggattgttctactaccagatgtgcgttttgtttacagaagtgcggttttttacatttgcacttatacgcgtattttgcagtcatgtaatgtaattgaaggggtaagtgatttttttagttcctcttgtcccccctaggaacatgttggacctctgtaaattgttcgtttgaactttgaaatgtacatcggctgtgttctgcctatcac

SEQ ID NO: 7600 - DNA, 749 bp, Zea mays
ccctttcccaagaaaccaagaacccagcccctcaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttcttaatccagcgccaatgcatccacacatttacagcaacgggcacatctgcttagatattctgtatgactcatggtcaccagcgatgaccgtgagctctgtctgtatcagtatcctgtctatgctgtctagttcgccagcaaagcaacgcccggcggacaatgaccgctatgttaggaactgccgcaacgggaggtcgccaaaggagactagatggtggttccatgacgacacggtgtaatgatctccgtggcattgcctgtcagccttctgtactgtgaactgtgatatatctcttcaagggggagatgagatgatttaggcctatttctaagcagccctctattggattgcgaagcttaccttgctgtgttggtatgtaaatgagttgctcacatgtgtcagtctgggaatatgtgttatcaccatcaatgatataatatatagaataaagcaagattgtaccct

SEQ ID NO: 7601 - DNA, 1060 bp, Zea mays
gttccgatcctccacaccagcacccgccgccgccgcctcttcccttgcgcacctgctgctgtgcggatcggtgaggcggaggagtaggatggcgagcgcggccggaggcggagcggcgggggaaggggagtggcttaaggtatcccagctcaggcccatggtggaagcgcaggaccccaacgccaaggcagtggacaacctgacgctgcgtcggttcctgcgcgcgcgcgaccacgacgtggacaaggcctccgccatgttcctcaagttcctcaagtggcggagggaggcggcgcccggcggctccgtgccggaggagcaggtgaggagggagctgtcgcaggacaagctgtgcatgggcggcgtcgacagggccggccgccccatcctcgtcgccttcgcggccaggcacttctccgccggccgtgacatggcagagttcaagagttttgttgtctacttcttcgacaagatctgtgccagaatccccagagggcaggagaaattcctctgcatcgttgatctcaagggctgggggtactcaaactgtgacgtccgggcatacattgccgctatagagatcttgcagaactactacccggagcggctcggcaaggcgctgatgatccacgtgccctacatcttcatgaaggcgtggaagatgatctaccccttcatcgacaccaacaccagggacaagttcgtgttcgtggaggacaagagcctgcaggagacgctgcggcgggagatcgacgaggggcagctcccggagttcctcggcggcaagatggacgtgatcccactcaaggactatggcgtgcagcagcagcctcaggccgtgtaatagccatgccatgcgtagcatacacgagttgtggctaggagcatagcatggcaataactgtgtagctgctgtgaaagtgaaaatgaaacgttgcgctgtttagccgggtcaattgaccagcccaactgcagatctctgggctaccactatgaacagcaagaactgtttcccttatccttttcagccaaactaatcaaaccagaaaatgtttcttgt

SEQ ID NO: 7602 - DNA, 833 bp, Zea mays
accagttgatacatgtcttgtgacttgtgaagtgtgttcctatctgcatcaccttccttcgccttgcaaccctttggctagttcattcatacgaatggattattctaatttgcgtcgccaagctgcatccatgaaaaagactctctttgatcaggggtacctagatgagcaattttgccaggtggaagacttgcaggatgaagctagtcctaatttcgcggaagaggttgtcactttgtttttcaaggactcggccaggctaatatcaaatgctgaacaggctctggaaaaataccccaaagatttcaatagatgggatgcatacatgcagcagctaaaaggcagctgttccagcattggtgcttcaaggatgaagagtgagtgcgtgtcattccgggattactgcggacagggaaatgttgaaggttgtatgagatcgttccagaaagtgaagagggagcacggtgccctgaggcagaaactagaggcctatttccagctgctacgacaagctggtcctgctggagctgccaccaggcctggatgtaagaactaggagttgcaggaaaacggagtatgacccaagaagatacctcactacaactgactggcccagtggccctgctgcgcagcaattaggggtcagcatacgaagaaaacaagagatgatatgcatggatatgcacaaaactgtaataagagattgttttttcaagaacaaaaaaaaaatcagaggagaggaagggatgggaaccttgtgtagtgagtttacaagctttactgaaagatggtattattgtctcatgtgtaatatattccttccattttaaaat

SEQ ID NO: 7603 - DNA, 1538 bp, Zea mays
tcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttgaacatgagactccaaaagttgaaataagtggatgtggagacctgttgtgcactagcagccagcatgcgtttttatgctgctttagacatgaaaatgtatatccaacacaggcctgtgaataagatgatgaaagtatatccaatcgctgcacttcatttggttgtgtgcc

SEQ ID NO: 7604 - DNA, 674 bp, Zea mays
ctttctcccctcttccgcacccgcttctcgctccggattccctctgctctttccctaacgaaggtagccatggcggggagaggtaaggcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgctgaggttcttgagctggccggcaatgcggcacgtgacaacaagaagacccgcatcgtaccgcgccacatccagctcgccgtccgcaacgacgaagagctctcccgcttgctgggcacggtgaccatcgctagcggtggtgtcatgcccaacatccataacctgcttctcccgaagaaggccggcggcggcagcgccaaggctgcggctggtgacgaggactaagtccttgactacgcctggtggcacgtcccaggatgctgccgtatcaacttgtgtctgtgtagtacgttaggtgttcgttgtagctgggtatgtgggttgctgtaacactgctaaactaagttactcttgtgcttgctaaggattaagttctgtatttgttgctataaaaggtgcatcctttgaatgactggttcatc

SEQ ID NO: 7605 - DNA, 1330 bp, Zea mays
ggctcgagggcttagtggtccaaccgctggttggcctgtacagcgataggtgcacagcaagatggggaagacgcaggccatttatcctgataggatgcatgctcatctgccttgccgtcattgttgttggcttctcgtccgacatcggagctgctctaggggacacaaaggaacactgcagcctctaccacggccctcgttggcatgctgcgatcgtgtacgttctggggttttggctccttgacttctccaacaatactgtgcaaggtccagcgcgtgctatgatggctgatctgtgcggtcatcatgggcctagtgcagccaactcaatcttctgttcttggatggcgctgggaaacatcctaggctattcctctggctccacaaacaactggcacaagtggtttccgttccttatgacaaacgcgtgctgtgaagcctgcgcaaacctgaaaggcgcgtttctggtggctgtggtgttcctagtcatgtgcttgactataaccctgttcttcgccaaggaagtgccctacagaggaaaccagaacctccccacaaaggcaaacggcgaggtcgagactgaaccttccggcccactcgctgtgctcaagggcttcaagaacttgcccacggggatgccgtccgtgctcctcgtaactggactcacctggctctcttggttcccgttcatcctctacgacaccgactggatgggccgtgagatctaccacggcgaccccaagggtagcaacgctcagatctcggcgttcgacgaaggcgtcagagttggctcgttcgggctgctgctcaactcgatcgttctaggattcagctcgttcctgatcgagcccatgtgccggaaggtcgggccgagggtggtgtgggtgacgagcaacttcatggtctgcgtcgccatggcggccaccgcgctgatcagcttctggtcgctcaaggactaccacggatacgtgcaggacgccatcaccgccagcacgagcatcaaggccgtctgcctcgtcctcttcgcgttcctgggtgtccctctcgccatcctgtacagcgtcccgttcgcggtgacggcgcagctggcggccacgaagggcggcgggcaggggctgtgcaccggcgtgctcaacatctccatcgtcatccctcaggtgatcatcgcgctgggcgcgggcccgtgggacgcgctgttcggcaagggcaacatcccggcgttcggcgtggcgtcggggttcgccctcatcggcggcgtcgtgggcgtgttcctgctgcccaagatctccaagcgccagttccgcgccgtcagcgcgggcggccactgatc

SEQ ID NO: 7606 - DNA, 630 bp, Zea mays
ggctcgagtttccctcccctgtttctaacaaaggccgctgttctaactctggttcttgttcaggacacgatcaaggcaccgccaccgtcggagtccaaggtgatgcagaaggcgacgcgcctcagcgtggcgacgaccaccatcttctacatgctgtgcgggtgcatggggtacgcggcgttcggcgacaaggcgccggacaacctcctcaccggcttcggcttcttcgagccgttctggctcatcgacatcgccaacgtcgccatcgtcgtgcacctggtcggcgcgtaccaggtgttctgccagcccatcttcgccttcgtcgagcgccgcgccgccgcggcctggcccgacagcgccttcgtctcccaggagctccgcgtgggccccttcgcggtcagcgtgttccgcctgacatggcggtcgtccttcgtgtgcgtcaccaccgtcgttgccatgctgctgccgttcttcggcaacgtggtggggttcctcggcgccgtctccttctggccgctcaccgtctacttccccgtcgagatgtacatcaagcagcgccgcgtgccgcgcggcagcaccaagtggatctgtctccagacgctcagcgtcagctgcctcctcgtctccgtg

SEQ ID NO: 7607 - DNA, 1719 bp, Zea mays
tgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatatatgcatgtttcgagatggctctcccttaattaattattacataccgtgtgttactagcttagcttttgcctggctgccggctatatatatatacttgtttgcct

SEQ ID NO: 7608 - DNA, 1693 bp, Zea mays
ggcgaggcaaaagcgcaaacgcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacaggaaatcttgctggtcttgccat

SEQ ID NO: 7609 - DNA, 1501 bp, Zea mays
gtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcaggtcgattgcatggcttcccttatatggcgtcatcagcggttttgatacgtaccggccattcagatatttaggatatagtttgagaagtttcctggccaattcagtgtcgtagtgttttttatttgacatctgtgtacctaaatcttacaccatttctcaaaacacagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtg

SEQ ID NO: 7610 - DNA, 828 bp, Zea mays
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 7611 - DNA, 2146 bp, Zea mays
agttcttccctcctccgacgccccagcccaccaacacactctataaagcagccccccagtcacacacagaacgcacaagcgcaagcagggcaagaaaactccgcaggccagtctgcgcgagttggatggccttcttcttggccctcgtgtgcatcctcgtcttgctagccatcgcctcctacgtccagtacactcgctggcagaaggggaaaggccgcttcggcggccatgggaggtctgctcccttgaagctgcctcctggctccatgggctggccttaccttggcgagaccctccagctttactcccaggaccccagcgtcttcttcgcttccaaacagaagaggttagtcgccgtaggcaactactactactactcatgcgggcagcgtgttcgtccttcgttctggatccgcccccttgttcacaagctgctaatgattcgaacggaaccatgcatgccttgtgtgcaggtacggcgagatcttcaagacgcaccttctgggctgcccgtgcgtgatgctggcgagcccggaggcggcgcggttcgtgctggtgacgcaggcgcacctgttcaagccgacctacccgcggagcaaggagcgcatgatcgggccgtcggctctcttcttccaccagggcgactaccacctccgcctccgcaagctcgtccagggcgcgctcggccccgacgcgctgcgcgcgctcgttcctgaggtggaggccgccgtgcggtccactctcgcttcctgggacgccggccacgtcagaagcacgttccacgccatgaagacgctgtcgtttgacgtgggcatcgtgacgatcttcggcggccggctggacgagtggcgcaaggcggagctgaggaagaattactccgtcgtggagaaggggtacaactccttccccaacagcctgccggggacgctccattacaaggcgatgcaggcgcggcggcggctgcacggcgtgctgtgcgacatcatgcgggagcgtcgtggccaggcccaggcgggcaccaccggcctgctgggctgcctgatgcggtcccggggcgacgacggcgcgccgctgctgagcgacgagcagatcgccgacaacgtcatcggcgtgctgttcgcggcgcaggacacgacggccagcgcgctcacctggatcgtcaagtacctccacgaccaccccaagctcctcgaggccgtccgggcggagcaggcggcggtccgcgaggccaccggcggcgggaggcagccgctggcgtgggcgcacacgaagagcatggcgctaacgcatagggtgattttggagagcttaaggatggcgagcatcatctcgttcacgttcagggaggccgtggccgacgtggagtacaaagggttccttatccccaaggggtggaaggtgatgcctctcttcaggaacatccaccacagccctgactacttccaggatccacacaagttcgacccttctagattccaggtggcgccgcgtccgagcacgttcctgccgtttgggcacggcgtgcacgcgtgccccgggaacgagctggccaagctcgagatgctcgtcctcatccaccacctggtcaccggctacaggtgcgtccatctcctctcagatcctctccatatattccccgcttgtcctatagcttgtggaccagggatgacacatggctggctgctgccgctctccatggggctccggctctctctctccgtgcatgctccaaatctcctcctgtctgtggcaaatcgttggatccagtgacgaggtcgagtacagcccgttccctgtgcccaagcacggcttgcctgtcagattatggagacaaaacaatccggtcgtcgacagaaaggggcgtgagaccgacgacgatgatgtggaggatattttagtttgactcttgagttaggcatgaatttaaccccaagctagctagagaagttttttttccctttgaaattcttctttgctcgccttcctcctggatcaaattacgttggaggacaagaaacggcagctttctctttcgttttctttgcctgcttcaccgcgacgataatggtgaaaatatgtaagctacgtggacatcaatgatccacagcatcgttgatatatataatatagagagaaaattctctgc

SEQ ID NO: 7612 - DNA, 1350 bp, Zea mays
cttcccttctttcccctttgcttgctgctgcctgcttctcgccgtcgccgcctcaattccctcctcgttgtccgtcgcctcgtccacgcgcacctcgtcctcctctccgttccctccacctcctcgaccgcaccgtcgtcgtctagctagcggagcgagctgcgaccagatcggagagccaagcacccaggaagagggggccggggaacaagaagaagccgccggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcaccggcgcgctcgtctccatcgaggtcgtcgactcctccatccgcctctggcaggcgcgccgatccgggatctggagcatcctctacgtgctgaacgtgatctacagcctcctgacgggcaggctggtgcgcgagaaggtcgacccggcggtgcagcgggtggtccgcagccagatgaacgcggtggactcgtcgccgttcagggagtcgccggacctgttcgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatggacgatgttcttctctgcgatcgagccgatgatgtgtgtgtgtgtgtgcccccgccgccaccaccgatagctgctgctagggtcggaggagggaggaggaagaagagactgacatctatagaacccttaatttatagagagggcttttgctttgctacttgtacgtgctctactacgtacctattgcaacttttttttttgattcaccatgatcgacctccttcctcagatccatccatgcatgtaatataccctggaccggcttgtgcttcgttcgatcc

SEQ ID NO: 7613 - DNA, 1320 bp, Zea mays
cgcacgccttcccgttgtccatttgctccacgggccagcctgccggcgccgccactgcaaagtccgtacacacagacacacaacgcacgtcaccgccatgtctgccgccactgcttgcatgcccctggtccttgatccgtctcctctccatggatcggcggcaatggcagatgccgttgagaggcggcagcccggtggcatggagaccaccaagaccggttccgagggaacgctcggccgcgtcgtcaggagccaagtgtttggcaacgaggacgacgaccgtgctgggcacggcgacggcgacgaggtgagcaagccgcgggcggtggtccacacactgacgtgcgagcgcaagccattgttcgagggcttcgcgctctggcggagcatcggcaggcctgagcttcccgaactggatccaatcttatcgttcgacgaattcgagttttctgctccagctggcttccttgaccatcctcacaggggatttgagaacgttacctatatgctcgagggcggcatcagttaccacgacttttcaggccacaagggaaccatcaacccaggagacgttcagtggctgacggcggggcgcggcgtcgtgcacgcggagatgcccgccgccggccagggagtacagaggggcatcaacatctggatcaacctctctgccgccgacaagatggtggagccgaggtaccaggacctggcgagccacgacatccccgccgccgcggcggacgccgctggcggcgtctccgtcaaggtcatcgcgggcgagtgcctcggcgcgcgctccccgctccggccccgcaccccggcgctgtgcctcgacgtcgccctgcggcccggcgcgcgcctgcgccagcctgtcccgcgcgggtggagcgcctgcgcgtacgtcatccacggcgaggccgccttcggcactgcctccggcgagggtaacggcgcctccacggctaccgcgcgcacgctcgtcgtgttcggtggcgacggcgacggcgtggagctgcggggcgatgcagcgggccagggcgcgagggtcatgctggtcgcagctcggtcgcacggcgaggcggtggcgcgggacggccccttcgtcatgaatacccgggaggaggtggaccaggcgcgggaggactaccgccaccgccgcaacggcttcgagatggccgacggctggacctccgatcacgcctccgcagctgaaaagcattcataggatacacctaccttaggctagtcgcgcgcggatgcaactgtgtaaggctttatatgtagtttgatttccatcaataatccacaagttttatttcc

SEQ ID NO: 7614 - DNA, 1075 bp, Zea mays
ggcaggcagcaggccttcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgaggccggacctcaagaggggcctgctctccgacgacgaggagaggctcgtcatcgacctgcacgcgcagctcgggaacaggtggtccaagatcgcggcgcagctaccgggcaggacggacaacgagatcaagaaccactggaacacacacatccgcaagaagctcgtccggatggggatcgaccccgtcacccacctgccgttgcaggaaccgccggctcctgctcctgctcccgccgagcagcaggagcagagccacaggcagcaagaagaactgcaactgcaagagctgcagaacggccgcgagcttatcatgcaggagggcgcgggggaagacgatatcacgccgatgatccagccgcacgagatcatgccgacggcggcagcggcaagcaactgcggctctgtttcctctgcccacgccggctccgcgtccgtggtctcgccgtcctgctcctcctcggcggtgtccggcgtggagtggccggagcccatgtacctgctcggcatggatggcatcatggacgccgactggggcagcctcttccccgacactggcgctggcggcggcggcggcggcttcgacttgggcgtcgatccgttcgaccagtacccgggcggtggcttcgaccaagaagacgaccacagaatatgacatcggcctagcaatgcacatagattcgccgcttctccttccatctcgctcagcacatcagcgccgtagcctccatgttttcttaatagctctccagggtccagtgctgataaacaagaactgacaaattcgggtgcgg

SEQ ID NO: 7615 - DNA, 817 bp, Zea mays
gcgagaccaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaagctccgtctcctctagaagccgcagcaacgatcggtctatagtttgaactcgcctttgaataacttgtcgttgggcaaggtctagttcggtgttgtgtatggaacggtcgtcactgagtcatgcacgatttggtatccgtgttgtttatgttcaccggtttgaggaactctctgatccgccgtgacacaaagttgatcctgagagaacgaccgagtatttttttttcctgcaaa

SEQ ID NO: 7616 - DNA, 932 bp, Zea mays
gtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgagaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataataatgggtcaactgacaactctgggtcggtggatttgtagttggtttgggttttttagttgtagaacggtgttgccctcctagagagggatgaacacattatgcatgcgatgtgtcagttcggtcggtgctatgctcgttgggatttgattgtcggaaataaaacatgggtgatgaatgtgtaccctccct

SEQ ID NO: 7617 - DNA, 809 bp, Zea mays
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagg

SEQ ID NO: 7618 - DNA, 651 bp, Zea mays
gacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttcac

SEQ ID NO: 7619 - DNA, 831 bp, Zea mays
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaatcagcatggactgcggatcgatgggtgctgttacccccgtcaggctttattctaagttaaatcctaaggaaaaaaatggtgcttcttggtgctgc

SEQ ID NO: 7620 - DNA, 1624 bp, Zea mays
cgagcgaaaaccacggtccacggaccacggctatgttccactccaggtggaggctgcagccccggtttcgcaagccgcgccgtggtttgcttgcccacaggcggccaaaccgcaccctccttcccgctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactacaagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggt

SEQ ID NO: 7621 - DNA, 1314 bp, Zea mays
cactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggcgatcgatgagaacggcgagattatcaagaggaagaagaagaagatgggcctcaaggagaagctcaaggagaagctgccgggccacaaggacggccaccacacggccgcaccgtccccggcgcccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggctacctggatgcgttaataattgctttggtttctgccc

SEQ ID NO: 7622 - DNA, 819 bp, Zea mays
ccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgtt

SEQ ID NO: 7623 - DNA, 802 bp, Zea mays
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagg

SEQ ID NO: 7624 - DNA, 1482 bp, Zea mays
gtaaatttgaaagaggttaatcatatgtgccctttcaatacagccgcttttccagacagtcttgcaattgctaaagagggtgagctttcaattggaactattgatgatatccagaagcttcatatccgcacaatcccccttaatgaacaagcacgccgcatttgccaccaggagcaatcaaagacactagcattttgcagtttcaagtacaaccagagtgtggaggaaagtgagactcacttaatacgtctgctagatcatcagacttttgagtccctgtgtgtgtatcctctagaccagtatgaatgtggctgctccatcattagctgttcgtttgtggatgacaataatgtctattactgtgtgggaactgcatatgttatacctgaagaaaatgaaccaaccaagggccgaatccttgtatttgcagttgaagatggaagtttgcaattaattgtggagaaagaaaccaaaggagcagtttattcgttgaatgcattcaatgggaaattgttggctgctatcaaccagaagattcaattatacaagtggatgtcgcgcgaggatggttcacatgagctgcaatctgagtgtggccaccatgggcacatacttgccttgtacactcaaacacgtggtgacttcattgtggttggcgatctgatgaagtcaatttccttgctggtgtataagcatgaggaaagcgcgatcgaagagcgtgctagggattacaatgcaaactggatgactgcagttgagatgcttgatgatgaagtctatgttggggcggagaatggctataacttattcaccgtgcgcaagaacagtgatgctgccacagatgacgaaagggccaagcttgaggtcgttggggagtaccatctcggggagtttgtgaacagattccgccatggttcactcgtgatgcgccttccagactcagagatagggaagattcctacggtcatctttggcacaataaacggggtcattggcattatcgcctccctcccgcatgaccattacaccttcctggagaagttccagtccactcttgtcaagtacataaagggagttggaaacatgagccatgagcaatggcggtcgttccataacgacaagaagacagcggaggcaaggaacttccttgatggtgacctgatcgagtcgttccttgaccttagccggagcaagatggaggtggtgtccaaggctatgggcgtttcggtggaggatctgtccaagattgtggaagagctgacgaggcttcactagtacatggatacgcaaaagctttgcttgtaacttgatgcatgtacatcctctttttgccatctatttttgtgctgtagcagttccatgagctgcctcagcagttgccgcgggccgtgttggcccgaagctgtagcctgccctgctttgttggttgactcggaatactttttgggttgtgccagtttgttgagattgttttttttcttt

SEQ ID NO: 7625 - DNA, 1809 bp, Zea mays
ccgatctggcccagctctgggttgcgcgaacagtcggaaccctaattccctccccggcgccggcgccggcgccccctagctgcgcccccacgaccagcagaatccagatcgaagttttgctcttgccgcggccccgcctaaactccaaaagtgcgaaccccctaactcatcgatcccagcctgcctccgcctacgcgcctcgtgacggcgtggacccctcccctatctgcgtgctgcgcgcatccgcctgcggcctgtcccgtgcagccgtgcctcctccgcgcacatctccagggtctagccgagagcagaccgccgtgacgccaccactcgcgctcgcgctcctgacatcgttgtctgccttctctgtctaagatcagagcagagctccatcgaaagcgtcgcccgcctgcttggatgatcaatcaccacgaaatagtgcagtttgggaagctgtacaatagagacatggaatcagctcctgctcatacccctcttatacatggtcttcctgatgaggtagctctcatttgcttggcaagagttcctcggcggtatcataatattctcaggcgtgtctcaaggagatggagagctctgttatgcagtgaagaatggcacttgtgccgcaagaggaataacttggacgagccgtggatctatgtaatctgtagggaagcaggcatcaaatgctatgtgttggctccagatcctccaagccggtgctttcgaatcatgcatgtcattgaacccccatgctcagggaggaaaggtgttaccattgaagctttagacaaaaagctatttcttctgggtggctgcagttccgtgtatgatgctacggatgaagtatattgttatgacgcatcctcaaatcgctggagctcagctgctccaatgcctacagcaaggtgctattttgtgtctgcatcccttaaggagaagttgtacataactgatggatacggcttgacggacaagtcaccaaattcatgggacatctatgacccggccacggactcgtggtgcacccacaagaacccgttgctcacccctgacatagtgaaattcgtcgcattgggggaggagctggtgaccattcaccgagcggcgtggcacaggatgtactttgccggcgtatacgacccgctggaacgcacctggaggggcagagggaacgagatcgctctctgctactcgagcccgacggtggtcgtggacgggacgctgtacatgctggagcagtccatgggcacgaagctgatggtgtggcgggaggacgccaaggagtgggccatgctcggcaggctctccgacaaggtcactagacccccctgcgcgctcgtggccatcggcaggaagattcatgtggtcggaagagggctgagcatggtcaccgtggatgtggacacggcggcaagggtggacgggttcctggttaccacctctgtaggcccgttggtggaggaagacctgaccccggagaggtgcgtggtgatcaccatctgaaggggtgggcgtgtccaagcttccttgacgccgggtgtattgtggtaactgtgactgactatcgtcgctggcgccgaacatttggctagctagcgtggatgatatatactgcgatgtgagtgaattcaataagaggcttggctctccatacagccaataactatagttagcatttgtatctcgtgttgtttgggctgcttttgtcgactgctggctgtaagaacaatatttgagcttcgtttgttgagtactgtgcgtcccagatggatgggattaatacaagctaatgtgatcctcgtc

SEQ ID NO: 7626 - DNA, 731 bp, Zea mays
tgtcgatccaattgtcacttgctctccctccaacaagctaattaaggccggtcatccctcttctagctcgtttcattatccatggcggaggagaagcaccaccaccaccacctgttccaccacaagaaggacgaggagcaggaggagcagctcgccggcggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatcctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttactt

SEQ ID NO: 7627 - DNA, 876 bp, Zea mays
ctttatgaaatggaagcagcatttaagcctcaagtaaatgatgaactggatacacagaatttcatgaaatttgaagaactggaaaatcctccagccaaaacaggctctgggccttcaagaaagatgatgctgaactccaaggatctgagctttgtggggtatacatacaaaaactttgatgcagtgaaagcaataaaaatttcaggaattcatctctaacaaggccttccattggttcgatattcggtccaccaggcatggattctcccatggaaccaaacggaagggacacacacatgcacacagtttcatctggtgacccaatgattccctaaccttcagtgacgtctgtcctcagcaaatttccgaactaaatcagcatgcgaacgccagggtgatgtggctccagctggacaacatgcttatttttagccaggtctctgctctctttatcgtgggcaagcggtttgtagaaatccaccaaagtttctagttgtaaaatagtatgccacagacttcaacaaaggtcccatgcgttattgtttcatcagacatgggggcagttttttttggagaaattgcaccttgcggctggctgcccaggttggcagagcaaattgcggccttctcttgtggcagttcccggtccgcaggaaagggaaatacgacggtgttgttgcagcaggaattctcatggttagtgtctttgttggtgtttgatatgtatcaggaattttcacatttgaagtagggtttctgttagcagagttgtagctattgacaagcaacgtcctttcacggagttgctttttttcgttgatgtatggaaaacgagacattgtagaaatcgaagttcgatctagccttttatgctgc

SEQ ID NO: 7628 - DNA, 1796 bp, Zea mays
aagctaggcaggcctggtcccgaagaacacccttctctggtcgtcgcagggcagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggccgggcagctcttcttcggctggctgggcgacaagctggggcgcaagagcgtgtacgggatgacgctcatggtcatggtcatctgctccgtcgcgtcgggtctctcgttcggccacacccccacgggggtcatggccacgctctgcttcttccgcttctggctcggcttcggcatcggcggcgactacccgctgtcggccaccatcatgtccgagtacgccaacaagaggacccgcggcgccttcatcgccgccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacatcgtgtggcgggtcatcgtcatgctcggcgccgcgccggcgctgctcacctactactggcggatgaagatgcccgagacggcgcggtacacggcgctggtggccaagaacgccaagcaggccgccgccgacatgtccaaggtgctgcacacggagatcgtggacgagcaggagaagctggacgccgccgagggcgccaacagcttcggcctcttctccagggagttcgcgcgccgccacggcctccacctcgtgggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagaccctcatcgcgctctgcggcacagtcccgggctactggttcaccgtcgcgctcatcgacgtcgtcggccgcttcgccatacagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaggagcaagacggacgccggctaccccgcgggcatcggcgtgcgcaactcgctcttcgtcctcgccgccagcaacatgctcggcttcgtcctcacgttcctcgtgccggagtccaagggcaagtcgctcgaggagatgtccggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgtttttttccacgttaaagtcaaccctggctgtgttttgatgtgc

SEQ ID NO: 7629 - DNA, 1801 bp, Zea mays
cgccaaacggaccaagaatttccacgcagatttcaacagagatgatgggctcgcccgccggtgctggtgcactcgcccatgtctcgcgcgtcgcaccgccgaggacggcgccccgattcgtcctccttatttaggcaccgtcttttgtcccccccatccgttccgagccgaaccaaggcgccatgagctccccggccgtgcgccgcgtcgtactcctctcgtcactcctctgcgccggagcgctcggtttcttgccctgctcccatgccgccgcggtggcgcccggctacgtcgccgtctccgccgccagcttcgtgccgtcctcaacgtgcagctcccccgaccgagttccgccgcaccggcggaacggcacgtccgccgtgctgcggctgacgcacaggcacgggccgtgcgccccctcgcgggcgtcctcgctagcggccccgtcggtggctgacacgctgcgcgcggaccagcgccgggcggagtacatactgaggagggtgtcggggcgcgcgcctcagctgtgggactccaaggcggcggcggcggtggcgacggtgccggcgagctgggggtacgacatcggcacgctcaactacgtggtgacggcgagcctcggcacgccgggcgtggcgcagaccatggaggtggacaccggcagcgacctgtcgtgggtgcagtgcaagccgtgcgccgcggcgccgtcgtgctacagccagaaggacccgctcttcgaccccgcccagtcgtcgtcctacgccgccgtgccgtgcgggggccccgtgtgcgcggggctgggcatctacgccgcgtccgcctgctcggcggcgcagtgcgggtacgtggtcagctacggcgacgggtccaacaccacgggcgtgtacagctccgacacgctgaccctgtcggcgagcagcgcggtgcagggcttcttcttcggctgcgggcacgcgcagagcgggctgttcaacggcgtcgacgggctcctgggcctcggccgcgagcagccgtcgctcgtggagcagacggcgggcacctacggcggggtcttctcctactgcctcccgacgaagccgtccaccgcggggtacctcacgctgggcgtgggcgggccgtcgggcgccgcgccgggcttctccacgacgcagctgctgccgtcgccgaacgcgccgacctactacgtcgtcatgctgacggggatcagcgtcggcgggcagcagctcagcgtgcccgcgtcggcgttcgcgggcgggacggtggtggacaccggcacggtcgtcacccgcttgcccccgaccgcgtacgcggcgctgcggtccgcgttccgcagcggcatggcctcgtacgggtacccgacagcgccgtcgaacgggatcctggacacctgctacaacttcgccgggtacggcaccgtgacgctcccgaacgtggcgctcaccttcggcagcggcgcgaccgtcacgctgggcgccgacgggatcctgtcgttcgggtgcctcgcgttcgcacccagcggcagtgacggtggcatggccatcctcggcaacgtgcagcagcgctcgttcgaggtgcgcatcgacggcacctccgttggcttcaaacccagctcctgctaactcatggattaacagtcggcgacttgggatcactactagtagtagtatatgcacgtacgtagacgagagtgcagagatacatacaaagttactgtacatgatgatagtaaagataaacttgcaggagagcgtataccatacacagcacacagcagtagcggtggaagttctttcgttggtgg

SEQ ID NO: 7630 - DNA, 1519 bp, Zea mays
cattttctcgctcctcacaggctcatctcgctttggatcgattggtttcgtaactggtgagggactgagggtctcggagtggattgatttgggattctgttcgaagatttgcggaggggggcaatggcgaccgcggggaaggtgatcaattgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactacaagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggt

SEQ ID NO: 7631 - DNA, 633 bp, Zea mays
caaaaccagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggtttcccgagggccttgctgattggcagagcagccagcacccctggatctacgagaagtaaacagtgaaagtttcacatgaaaccttgagagctagaggaagcatgtcaccatttgtgctttagcaaagttttcgaaaagattatgatctgtatcttggaaccttatttccatggaccaaatttatttctttgcc

SEQ ID NO: 7632 - DNA, 1243 bp, Zea mays
aagaaacaatcaaccagcaacactcttctcgtataacataatacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttggtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgcggctcgtgattccaccgccctggttggtggaccatactgggacgtgccacttggccggagagactcgctcggtgcaagcatccagggctccaacaatgacatcccagcccccaacaacacactccccactatcatcaccaagttcaagcgccagggcctcaatgttgttgatgttgtcgccctctcaggtggtcacaccattggtatgtctcggtgcactagtttccggcagaggctatacaaccagacaggcaatggcatggctgacagcacactggatgtatcctacgccgcaaagctgaggcagggatgcccccgctctggtggtgacaacaacctcttccccttggacttcatcacccctgccaagtttgacaatttttactacaagaacctcctggccggcaagggccttctaagctctgatgagattctgttaaccaagagcgctgagacagcggccctcgtgaaggcatatgctgctgatgtcaatctcttcttccagcactttgcacagtctatggtgaatatgggcaacatctcgccactgacagggtcacaaggtgagatcaggaagaactgcaggaggctcaacaatgcccactgagggcactgaagtcgcttgatgtgctgaattgttcgtgatgttggtggcgtattttgtttaaataagtaagcatggctgtgattttatcatattatcgatctttggggttttatttaacacattgtaaaatgtgtatctattaataactcaatgtataagatgtgttcattcttcggttgcc

SEQ ID NO: 7633 - DNA, 1199 bp, Zea mays
acggcattggcgcgttgaccgcacgacctgccgattccttcgagcgatatagggcgcccccgtccacaccacccctcgtctccgccctagcgccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacggtacgaggaaatggttgagtacatggagaaggtggctaagaccgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcgaggattcatacaaagatagcaccttgatcatgcagctcctgagggacaacctaaccctatggaccgctgacagcacaacggaggacggcatcgaggagggcaatgaggcctcgaagggtgatgctggtgagggtcagtagtctggtaaaacctcgattgatggttcggcatgtttttgaagtctactgtgttggaaaccatgttctaatagaaggcgtctcccgctccatgcattccaagattctgtcctccccctccctccccccatgttgtaggctggtagtggtcaaattagttggccctgggtccatttggactgatgtattgtttactgctattgaagtcattcgttctcgttttgctct

SEQ ID NO: 7634 - DNA, 1117 bp, Zea mays
atccgcagttcccccgcgcccgagacgcaaccccgcgccaggagtaagtttgttcttttatcgatattatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaaggtgaggctggtgacggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcattaagtccgtgtggactggtattattcactggatttgagaagcatgtcagtggttgctctagcgttttattgagttttgaagtcatctccctc

SEQ ID NO: 7635 - DNA, 1480 bp, Zea mays
ctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccaccaaagcaagcggcggcacccgccgagaggaggagccgtccggtgtcggacaccatggcggcgctcatggccaagggcaagacggcgttcatcccgtacatcaccgcgggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccgcgagtggagtcactcatccaggaggttaagaaggtgactaacaagcccgttgctgttggcttcggcatatccaagccagagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgaccgaccaataaaaataagccaagtggaagtgaagcttagctgtatatacaccgtacgtcgtcgtcgtcgttccggatcgatctcggccggctagctagcagaacgtgtacgtagtagtatgtaatgcatggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgtat

SEQ ID NO: 7636 - DNA, 1864 bp, Zea mays
ctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctgtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaagacgg

SEQ ID NO: 7637 - DNA, 1990 bp, Zea mays
tggagaacgacctctccttcttacgcccggactcgccgctactgctcacccggaacagcatcaaccggagctgctccaccccgtgcctctgccccgtctccaaggacttcgagcacaaggactgcagcggactggttgagatgctcggctgctccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggagcttatgtgtatggaggccaggaagagagtagcagagtgggagcccttctctgccacagctgaacatggagaagataccgatttccagttctcggtggatatgctaggagaatacagtgatgtagtgcgatcaccaaggttcaatggctcaggttccaaagtgtccagtttcagaagccctttgtttaagctcgtcgagagcgtcgacgagggcagtgatggccatgaagatcaaaacgagtctgatcgagtcttgtatgctggatggaatacatctagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagagacactgcacgagagcgcaagggcagcagcaggtcaaaggatgaagcagcggctaggcacttcatgcaagttttgagcagggcaatagcgcatcagagaagaaaaaatatgcagtgctacttgtattgcttgcttatggagtgagtacaggatgaagatatcatcgtatgcggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaatgtttgtcagcctgtgtatattggcttgatgttagatactccagctttagcatgcaatttcttagtcgctgaaaattctttgtagcttgtgatgtgacctgtgagcagtgtaaacattgcacctttgatggaaaaataatgcttacctgttgttg

SEQ ID NO: 7638 - DNA, 1472 bp, Zea mays
aaaaaaaataataatcccaaattaaagaaaaggagcagaagaaaaacaactttcatcgccgtccgccaccggagctcacttcgtcggccttccctcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagatgttttcaagtaatgaaacagaactgatgttgtaagtttatgtttctgaagatttgtatgttcatatatataataatatgctttaacatgagac

SEQ ID NO: 7639 - DNA, 1480 bp, Zea mays
gcttcatgcgtggatcctcgtagaccccgacccgcgtgcactcaatccctaggcggcggcctccggcgcgaggctagcgggcggcacccatggcgtccgtggcggagctcaaggagaagcacgccgcagctacggcgtcggtgaactccctgcgcgagcgcctccgccagcgccgggagacgctcctcgacaccgacgtggcgaggtactccaagtcgcaggggagggtgccggtgagcttcaaccctacggatctggtctgctgccgcacgctgcagggccatagcggaaaggtatattctctggattggacccctgaaaagaattggatagtcagtgcctctcaagatggaaggttaattgtgtggaatgcattgacaagccagaaaacacatgccataaagctgcattgcccatgggttatggcgtgtgcttttgcacccaatggccaatctgtcgcctgtggtggtcttgatagtgcgtgctctattttcaatctcaattctcaagcagacagagatgggaacatgccagtatcaagaattcttactggacacaagggctatgtctcatcatgtcaatatgtcccagatcaggaaacacgtcttattactagttcaggtgatcaaacatgtgttctttgggatgttactactggacagaggatatcaatatttggtggtgaattcccatcagggcatacagctgatgttcaaagtgtgtccatcaactcatcaaatacaaatatgtttgtctctggctcatgtgatacaactgtgaggctgtgggatatcagaattgcaagtcgagctgttcgaacctaccatggacatgaggatgatgttaacagtgtgaagtttttccctgatggccataggtttggtactggctcagatgatggcacatgtagattatttgatatgagaacagggcatcaacttcaggtgtacagtagggagcctgatagaaatagtaatgaactacctactgttacatctattgcattttcaatatcaggaaggctactttttgctggttactccaatggtgactgttatgtgtgggacacacttctcgccgaggtggtacttaatttgggaaacctgcaaaactcccatgatggccgtataagttgcctcgggatgtcatctgatgggagtgcattgtgtacaggaagctgggacaaaaatttgaagatttgggccttcagtggacaccggaagatagtttgaaggccaacttttctcccccatgttgtatgttccttgttgccccttaacaacggacagtggtgattggtgaccaactcgacttgttcctgggaatccctttgttgttttgtaagctctgttcgcgctatgtttaatggaaaaatgtgcaatttgtcagtgtcacggcgctacatcttgttgagttggtaactgtttatactgttattacgagaatatcagtaacgtgtgatctgcccttttctttgtac

SEQ ID NO: 7640 - DNA, 924 bp, Zea mays
ctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacgccaccgccttcaccaacgccgacctcggcgccaagcaaggtggacatgagcctggttggcgtgaggttccagtagaggatcctgtggtcaaagatgctgcacaccatgctgtgaaatcgatccaagagaggtccaactccctgtttccctacgaacttctcgagatccttcgtgcccatgcacaggttgtggaagactttgcaaaatttgacattctgatgaaactgaagagaggcagcaaggaggagaagatcaaagccgaggtccataagagcctggaaggggcctttgtgctaaaccagcatcagccggcggagcatgatgagtcgagcagccagtgaactgacgtaactgtgtgagctgtagtagtaacgtacttcgtgttacgtagaagaataaggagaaaacgaccaatccggttttatctggatgtcatgtatggtcgacggtcgttgctggcttggcttccgaacgcagcaggcatactggtgctggaagacggtacctgctgtcgcacttgccgttataataggcattggaacttgtcgatttcgggagctgatctgtttgtaccgtattgtttatttataatatgatggatcgtatgttgatat

SEQ ID NO: 7641 - DNA, 1373 bp, Zea mays
ctctctctctctctctctctctctctctctctctctcttgttgggacctggagaagaggaaggaacagggagcaggggggaagaagaggttgctgcgacggctcaagcctcaaatttttggatccaggcagacaagcagagaaacaccagttggtcaagatgtcagctggtttccagctcggtgtgatcgggtcacttgcactctctgtcgcatcctcagttgccattgtcatctgcaacaaagctctcatcagcacgcttggttttccgttcgccacaacattaacaagctggcatctgatggtgaccttctgcaccctccatgtggcacatcgcttgcatttcttcgagcccaaggcgattgatggacagacggtgatactctttgggttgctgaatggcacgtcaattggccttctcaacctgagcttaggattcaactccattggattctaccagatgacaaaattggcgatcatacctttcactgtgctattggagactatcttcttgaacaaaagattcagcgagagtatcaaactctctcttctggtcttacttcttggagtaggaattgcttcaattactgatctcaagctaaacatgcttggttccatcctttctggcctcgccattgccactacttgtgttggccaaattctcacaaatacaatacagaagaggttgaaggtctcctcaacgcagcttctgtaccaatctgcgccttaccaggcaggaattctgtttgcaactggcccttttgtggatcaacttcttactgaccggagtgtctttgcacacaaatactctgctccagttctgggtttcattgtcctatcttgcttgattgcggtgtctgtgaacttcagtacatttcttgtgatcggaacaacatccccagtgacataccaggtgcttggtcaccttaagacatgtctggttctatcatttggttacactctattacatgatcctttcactctaaggaacatattgggcattctaattgccatatttggtatggcactatactcctacttctctgtaagagagggcaagaagaagtcagcaaatgatgctctaccagtttcacagatggcagataaggaggctgaaccacttttggcaactaaagacaacaacgacaccaagaaagcaaatggtttatctcacgactgctgaggcttttcttgtagtttaggtctagtatgaactgcccttcgaatttaaaggacctggaaagccattcttttcattcttgagttcctttttaggaaacggagcttttaaaatttgtatagaatgcatattttgacattaaaattattatttgattgtattctacacacagcagttccagctgaagttttact

SEQ ID NO: 7642 - DNA, 1142 bp, Zea mays
gccgccgccgctgcagtgtccatagccaccgcaggagactgagatggggggttttgtcaagacccacaagagcaatgcatacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatatctgctagtatagcaggtgatatggttcttgcttctgcttactcgcatgagttgccacgatatggtctcgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacgtacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttattatattaaaattggaccgagtcg

SEQ ID NO: 7643 - DNA, 1151 bp, Zea mays
ggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 7644 - DNA, 833 bp, Zea mays
caaccagttgcatatgcattttgtgcctactctacctttaaggcattcatttataaatggagtattctaatttgcagcagcaggcagcgtccttgaaaaagaacctctttgatcagggatacttggatgagcaattttgtcagattgaggacttgcaggatgaagcaagccctaattttacagaagaagttgtttccctgttcttcaagaactcaaccaggctaatgacaaatattgagcaagctatggacaggaatcccagagatttcagtaaatgggatgtaaacatgcagcaattaaaaggaacctgttctagcatcggtgcttgcaggatgaagaacgagtgcacctcattcagaaatagatgtggagacgagaacgttgaaggttgtatgaggtccttccagaacctgaagagggagcatggagtcctcaggcagaagctggaatcctacttccagctgctgcgacaagccggtcctgccgtgactgcaaccaggcctagaggcatgtaaggaacggctgttggcgtgcagggagcagtgcaagggacagacagcgtcatagcgatgctccactacgccattgttgaggctagctgtaacgatgggccacgaataagaagtttgcctatggcctgtgggggagttccctgcgggttttaaagtgtaacacccttcataatcgatgccttaagctggtgctgccgagtgccgactagctaggccggcatgtaagagcagcctagactgatgttgatgtggtctggcagacgtcctgtgctgtgcctgcctctgtatttcggtcaaataaataaactagatggagtttgc

SEQ ID NO: 7645 - DNA, 1582 bp, Zea mays
aacgaattgggatcgaaaaacatctccgttccccaccaccaccttcgctccttctgcttcgcccgtccccctccgtcgcgtcgactcccaagatggataagctcagtggttctgcacgtcttatgattgtttcagatcttgaccatacaatggtgaatgtcgtccaactcatatcttggtctgccttaagctatctgtatgtaaactcttcattcttttgggatggctaaaacttgcaggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttaaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccttatgcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgcgtgttctctgtcaagtcttgctttgattctgaaggctgaatccccagagggctttgtgctaacccacatccaaaagacatggctgaacggatactcgtcaggggttgagcaggcgtttaagctgtagagcagtataccgtctcggctcgtggttggagttttcttgagaatagaatagaataatgtacctgtttataatattaacttcccaaaaccgcactggaggatcaccagggagaggattcggtgccttctcct

SEQ ID NO: 7646 - DNA, 805 bp, Zea mays
gctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctactcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagaggtttagtcccatttgcattat

SEQ ID NO: 7647 - DNA, 1661 bp, Zea mays
cgaaaccgctagaggcagagggaggcgcagcacgaggaactcgttggtggcatcgagcgagcggtgcgagtggcacgagtgcgtgcgcgagcaagatcggagcttttccttcgtcgcagttgtggggaacgcggcgagcgcttccgtgatgggcgccggcgcccaggaggatgaggaggagataaccacggtggccgagggaggagtcggagaggaggagcaagcggcggctgagggcgcaggggaggaggagcagttggagcagggtgcagggggcgagggagagggtggggaggagaaagctccggcggtgatgttgtgctcgatctgcctcgacacagtggtcgccggaggcgaggagaggtccaccgcgaggctgcagtgcggtcacgaatttcacctcgattgcattggttcagcatttaatgccaaaggaatcatgcaatgccccaattgtcgcacgattgagatggggaactggctttatgcgaatggttctcgatcatcacaggacgtaaacaatgatgaatggggttatgatgacctatatgatcatggtcactcagagctggcaacctttgtgcctcttcgcattcagtggtgtcctattgggcgcctagaacttccatccttatttgaagaaggagagtccccagctccagctacttttaatgatttcacgggacaattcaactctgagcccatggtaccggtacctgccacacctcatcctggtccgtatctagcttattttcagcctgccccgacaccggtatcatcaagctcccttgtcgctgagagaacaatggatggtgctgcatatcatgatcactggaacactctggctgggctatcagatggccgacgaccctgggcgtactatcctcaacccaacagtgataatggtatagctgagcagcaaggactccctctgggggcaatggcggttggaggggttgatagtgaaagccaacaacgaggatctctctccttattttatggaaacgggtctggaagaccaaggatcccaggtgttcctcctatggcaccacaatttacaagagcgcatggcaacataaacgatcagttccagcagacagctagcttatttgctgggtcacagcaatcaggaggtatgcgtccattgggagcagtagggccttccgtgccaccacctccggagaacacctccttctgtctgttcccgccagcttcatccgtccccagtacaatggaggccgaggatgtcaacagagcaaaccagttctatgcatgggagagggatcgcctggctccttacccgctgatgcctgttaatagtgaaggtacctggtggagctcttcacaacagcagccccctccggagcctgctgcatctgcttcgaggaggctttctgggcagtggattggtaggttgccattgccaccaccagagaatagatcgccagacggctcgtccttccgtccactgcacatccctcggatgtagcgcaggaactggcaaggcgtaagttaatagtacaaacgtgggaaaccctgttggttgtaagtggtaacgccactgtaagaaagccccgtcggatggtaaaccttgtgataaaattcaggatgttgaagaaaccgaccctgaggtgaaaacatttttggcccggggtttatgc

SEQ ID NO: 7648 - DNA, 1622 bp, Zea mays
cttcaccccccctctcggtctcaccctcctggcgacgactgggcggccgaacggccgtcgccgccgccccacgccaggtttcaaagtcttcgtcaggcccttctccggcgactcgagcaccacagggtgacaaggatagctttctcgggtcactgaaggaagacatcttctcgacgcggtagaccttctgacggttggctggttgtgctataagtgttcaaggggtggattaggaccgggaaactctgtactgaagggaaggtcaaaagtgtcaagagagcttgttccaagatggatgaaggtcagggagttaggtattggtgccacatgtgtcaggaggtgatagatcctatgcccgagatgaagtgcccaggctgcgagggcgggtttgtggaggagatggactccgaagacttcgagccagctgcgaacgcgaggtctgatcgctccgtctctctcttggctccactgctgcttggtatgatggggggttcgtcgcgcagatcaagactcaggagggaggccatggttgaagctgatgccgaccaggatgacgaagaggatgattcagaccatgagcttgaactttccaggaggaggcggaggaggaggcgctcatcagcgcttttcagtgtgcttgaggctatgcgtgaccgtgatgaagtaaggggctcggatgacaccgacagtgatacagagagagacctggagagagggagaagggagaggatggagaggcagagggagaggttaaggcagatcgagagggtgagtgctcgtggcagagagaggacggaaagcttaatactgatcaactccaacaacgaggctattattctgcagggaacattcggatctgatgacaaccaggaggactcaagcaacacaagttctggtgtatcacttggggattactttcttggtcctgccttagacactctcttgcagcgtttggcggagagtgacctcagtcgttctggcacaccgcctgccaagaaggaagcagtcgccgcgctaccaaccgtgaacatcgaggaagcgttgggctgttcagtctgtcttgaggatttcgagatgggaggagaagcgaagcagatgccctgtcagcataagttccactcgcactgcatactcccgtggctggagctccacagctcttgcccaatctgccggtttcagttgcctactgaggagacgaagaacaacccatgcgaatcagccagcaccgcagggaccgtgaacggcggtggagacaacgctgctgcaagcggcagcgatacagaaagtactaaccacaatgaagatgaccattccgatagccctatcttctctgctctgagcacactcttctctgatccgttctcatccgacgatgatgaaagtgttccacactcttacgagaactgaagatagcgtcggacgcaggcttgcaatatggtgaagacgttctgcttctgaggctggcatctttatattgtagcttctgtacatatctctctgaacggtcgccccccataagacaaactattacctctccgttttactgaaaactatgtggcttgtaatctgctagtgcttgctatgttcacttgcctcgaataaatgttatcctttagcgtgct

SEQ ID NO: 7649 - DNA, 1931 bp, Zea mays
gggacagacagcggtgtcgcgggggcacctgcttcccaacgccgtccgcacctgctgccctgtcgtccgccctccttcccttctcctcccctccaactgtttcctcaacctcccgacccaaccacggccgtgcccgccaaggcgccaaccgcacagcagcagctggggtgctgacgtgctgtgggtggttctgttgtccatggcgcggaagcatcagcatgttgccatatttaccacagcgtgcttgccgtggatgactgggactgcggtaaacccactgtttcgggctgcataccttgccaaggctggagattgggaggtcacgctggtggtgccttggctgtccaagggggatcaggagctcgtttatccaaacaagatgaggttcagtttgccggcagagcaggaaaactatgtgcggcggtggcttgaggaacggactgggctgttgccgaagtttgacataaagttctatcctgggaagttttcaactgagaaaagaagtattctacctgttggagacatcagtcagacaatatctgatgataaagcggatattgcagtgctagaagagccagaacatcttacttggtaccaccatggacggaggtggaaaagcaagttccaaaaagttataggtgttgttcatacaaactatttggaatacgtgaaaagagagaaaaatggatacattagtgcgtttatcttaaaacacattaattcttgggttacagacatctattgtcataaggttataagattgtctgcagcaactcaggatgttccaaggtctgtgatttgtaatgttcatggagttaaccccaaatttattgagattggcaaattgaaacatcagcagctatgccaaagagagcaagcattcttcaagggtgcatattatatcggaaagatggtatggagtaaaggttacacagagcttcttcagcttcttcataagcaccaaatggaattgtctggccttaaaatggagttgtatggcagtggggaagatgctgatgaagtaaaggcatcagctgagcgactgagcttagatattagagtctatccaggccgtgatcatggagattcaatattccacgactacaaggtcttcataaacccaagtacaactgatgtggtatgcacaacaactgcagaagctttggcaatggggaagattgtgatctgtgcaaaccatccttcaaatgtttttttcaaaagatttcctaattgtcacatgtacaatactgatgaagagtttgtgagactaacaatgaaagctttggcagaagaacctatcccactgtcagatgatttgcggcatgaactttcctgggaggcagcaacagaaagatttattagggttgctgatattgcaccaactgtgcctgtgggacaaccaccaccctcctcgcagcatttcatgcgcatctccccagatgaactgcagaagaacatggaagaggcatctgcatttttccataatacaatctctgggtttgaagctgtgcgttgtgtgttcggtgcaataccaaacacactgcagccggatgaacagcaatgcaaggaacttgggtggaatttgcagggatagcattagcttttcttgcgatgctgttgccatggaccatagaatgaaccagtctaactcaacggcaaaaagctttgtcggaaaggttctcagattgatcaaacatacattctatgtggtgttctggtgtggggcactgcattttttcttcatatatcagaggcgttctgaagttcctggatgcatcgtatcttctgattgttaatcttaagcagtctgaagtgcacactagtattacagtctcatatatgtggactgtttttcatcatgttgtttcccaggattgacgcgtgtgttgaaaatcttattgtataataagatgccccttgttttcgcagcc

SEQ ID NO: 7650 - DNA, 2005 bp, Zea mays
cgcaggcagcatctgcatctctcgcccacctccgctccgcctactgctgctggtggtagggaggcggagaaggaggcccttgcgcccgcccgccggccggatcagagccgtagcaaccaccacccatggcggacgtgcacgaacctttggtgcgccgtaagaggaagaaggttttggtggactacttggtgaagttccgatggatcctcgtgatcttcgtggtccttcctatttcaactctgatctacttcaacatcttcctgggcgacatgtggtccgccatgaagtcggagaagaagcgccagaagcagcacgacgagaacgtgcagaaggtcgtgaagcggctcaagcagaggaacccgaagaaggacggtcttgtttgcacggccaggaagccctggatcgctgttggcatgcgcaacgtggactacaagcgtgcgaggcatttcgaggtcgacctttcttccttcaggaacatccttgagatcgacaaagagaggatggttgccaaggtcgagccccttgtcaacatgggtcagataaccagagctacctgcccaatgaaccttgcccttgcggtcgtcgccgagctcgacgacctcactgttggtgggctgatcaacggttacggcatcgaggggagctctcacctctatggccttttctccgacacggttgtcgcgatggaggttgttctcgcagatggccgggtcgtcagagccaccaaggacaacgagtactctgaccttttctatggcattccctggtcccagggaacactggggttccttgtctctgcggagatcaagctgatccccatcaaggagtacatgaagctcacctacactccagtcaaggggggtctaaaggagatcgcgcaggcctacgcggattctttcgcgccgagggacggtgacccggcaaaggtccctgactttgttgaagggatggtgtacacagagagcgagggtgtcatgatgacgggcgtgtacgcttccaaagaagaggcgaagaagaagggcaacaagatcaactgcgtggggtggtggtttaagccctggttctaccagcacgctcagacggcgctgaagaggggcgagtttgtggagtacatcccgacgagggagtactaccaccggcacacccggtgcctgtactgggaggggaagctgatcctgcccttcggcgaccagttctggttcaggttcctgctgggctggctgatgccaccgaaggtgtccctgctgaaggcgacccagggcgaggctatcaggaactactaccacgacaaccatgtgatccaggacatgctggtgccgctgtacaaggttggggatgcgctggagttcgtgcaccgcgagatggaggtgtatcctctgtggctgtgccctcaccggctgtacaagctgccggtgaagacgatggtgtacccggagcctgggttcgagcaccagcacaggcagggcgacacgagctacgcacagatgttcacggacgtgggcgtgtactacgcccccggggcggtgctgaggggggaggagttcaacggcgcggaggctgtgcacaggctggagcagtggctgatcgagaaccacagctaccagccgcagtacgcggtgtcggagctgaacgagaaggacttctggcgcatgttcgacgcgtcgcactacgagcactgccgccaaaagtacggggcggtgggcacgttcatgagcgtgtactacaagtccaagaaggggcgcaagacggagaaggaggtgcaggaggcggaggcggccatactggagccggcctacgcggacgaggaggcctaaaagctcgtggtcgttttgcttagcccattttaattagaacttgatggatgtagtgtgtgtctgtctcaagtcattttaattagaactcttaaagctcgtggtcggtcggtcagtcagtcagtcattgtcgttgatgtccagcgttgtgttttttttatattctctaatggaatctctcagattgattcggg

SEQ ID NO: 7651 - DNA, 2789 bp, Zea mays
gaactctgaaagagataatgccagtacttatggacacacttattgcatctcttgcatcatcttcctcagaaaggcgtcaggttgctggaagatcacttggtgagcttgtaaggaagcttggtgaaagagttttgccctcgattattccaatcctgtcacaaggactcaaagacccaagtgctagcagaagacaaggagtttgcattggtttgagtgaggtcatgggcagtgcaggaaaacaccagctattaagttttatggatgaacttattcctaccattcgtactgctctatgtgacagcacccaagaggtccgtgaatctgctgggttagcgtttagtactctgtacaagagtgctggactgcaagccattgatgagattgtccccacattgctacgagctttggaagatgatgatacatctgcaacagctcttgacggtctaaagcagattttaagtgtcagaacagcagctgttttgccccatatattgcccaaattagtccagcctcccctctcttcattcaatgcacatgcattaggtgctctagcagaggttgctgggccaggtttgaattcacatatcggaactgttctcccagcattgattcttgctatggatgatgaagatgcggatgtacaaaactcagccaggaaagctgctgaaactgttctgttggttattgatgaggaaggagtggaaactttgatacctgagcttctaagagggatcaatgacagtcaggcatcaatgaggcggggttcagcctatctaattggtttcctctttaaaaacactaaattatatttggctgatgaggcttctgatatgatgtcaaccctaataattttgttgagtgatacagacaaggctactgtatcggctgctttagaagcattttcaagagttgttgcatctgttccaaaggaacagctcccgacgcatataaaactagtgcgcgatgctgtctctacagccagagataaagagcgtagaaggcgaaagggtgtgcctattcttgtgcctggcttatgtcttcctaaagcactgcagccttttcttcctatatatcagcagggtttaattagtgggtcggccgagacaaaagaacaggcagctgaaggtctaggagagttaattgacgtaacaagtgagaagactcttaaggaagttgtagtgccaattacaggacctcttattcgcatccttggtgatcggtttccatggcaagttaagtcagctatcctatcaaccctgacaatcatcatcatgaaaggtggaattgcacttaagcccttccttccacaacttcaaactacatttgtaaaatgtctacaggataataataggtctgtccgggcgagggctgcagctgctctgggaaagcttagtgctctcagcacacgggtggatcctttagttagcgatcttctgtccatgttgcagtcaggagatgaatctgtcaaagaaagtgtgctttctgcgcttaaaggtgttatcaaacatgctggtaaaagtgtcagctctgcaataaggtcacgtggatgtgctcttcttgaagatctgctgcaggctgaagctgatgatgtccgcagttgtgctgcaaaagtgattggcacattgtctcagtacatggaggagacagagatttcagatttggtgcaaatcctattgaacatgagcacttcatcagactggtgtaccagacatggtgctttgttatcgttctcatacatatcaatgcattctccatcaaaattgtgtcatttggcatcctttccatctctggtcgatcttttgaaaggttctctcaaagacgacaagttccctgttcgtgaagttgctacaagaactctgggaaagatactctgttttgagctacagccagaagctggcaccttgcaacttgttcagctgcttatcttggccttgcgtgatgattcaagtgaagttaggagaagatctttgtcgtgtatcaaagctgctgcaaagacaaatcattcagctcttgctacacatcactctatattgggcccggcaattgctgaagctttgaaggactctagcatgcctgtacgtctagctgcggaacgctgcgcccttcatgttttccagttaacgaaagggccagataatgttacagcagcacaaaagtacctcgggatgactggcttggaagtgaagaaaatcgcaaagcttgacgtggacagtgatggtagtgagagcagcgatgatgacaagaggacatagactctactcaacagcaatcttttttcggttcagttgttatgatctttacatatagttagctacattgatagcggaatgtggggtcattttttctgtctggcccattttgtgtacatcctttttgacaacaaacaggtaaaagtgacaacgtttgcaaatcgacaaacaatggacacaagttgtattgcaaccaaggactgattcgttagtttgagcacagcacaaccacccagttcaacgataacgcatgtcaatgtaagccacgcataccatatagtatcatatcgtcgagtattgttcgtaccacatcttcctcccagttgatctccttgggcaaggtaggcccttccctggacagctcgttgggcatcttgttgagcatgctctctgctctgtacctgaacgctggagtccacgaacagactgctctgagcggcgtcaatgtggataggaatgtaatcggacgtatattactggttccatgtttgttttcatattttctcattggatattaatgcaaatattatcgagttgggc

SEQ ID NO: 7652 - DNA, 1612 bp, Zea mays
ctgcgaaccgaaaaaggagaagacggacaacgaattgggatcgaaaaacatctccgttccccaccaccaccttcgctccttctgcttcgcccgtccccctccgtcgcgtcgactcccaagatggataagctcagtggttctgcacgtcttatgattgtttcagatcttgaccatacaatggttgatcatcatgacgaggagaacctgtccttgcttaggtttggtgccctgtgggaatctgtttactgtgaggattctctactagtcttctcgactggaagatcaccaactctttacaaggaattaaggaaagagaagcctatgctaactccagacatcactatcatgtctgttggcactgagataacatatggggaggcaatggttcctgatgatggctgggaagaatatctgaacaataagtgggacaggaatattgttgtagcagaaactgtgagcttttctgagctgaagcttcagccagagacagaacagcgcccgcacaaggtcagcttttttgttgataagaagaatgcccaggaagtgataaaatctgttgccgagagattggacaaatgtgggctagatgccaaaataatatatagtggtggccaggaccttgatatattacctcaaggagctggaaagggccaagcacttgcatatttgcttaaaaagctaagctcatgtggaaaaccgcccaacaatactcttgtttgtggtgactctggtaatgatgcagaattattcagcatccctggtgtacatggtgtcatggtcagcaatgcccaagaggaactacttcagtggtacacagaaaatgcgaaggataacccaaagataattcattcaaatgagagatgtgcagctggtattatacaagctattggacacttcaagctaggacctaacatttctcctagagacctgcagtttccttatgcaaaggaagcctctttcaaacctacagatgctgtagtgaagttctacgttctctatgagaagtggcgcagggctgaggttccaaagtctgattcagttataaagtacttcaaaaacatcactcatgcaaatggagttaccatccatcctgctgggcttgaactctcactccatgcatccattgatgcgttgggatcatgttatggtgacaaacaagggagaaagtaccgagcatgggtggacagactttttatcacacagactggttcagatagttgggtggggaggtttgacttgtgggaatcagaaggtgatgtgcgtgcgtgttctctgtcaagtcttgctttgattctgaaggctgaatccccagagggctttgtgctaacccacatccaaaagacatggctgaacggatactcgtcaggggttgagcaggcgtttaagctgtagagcagtataccgtctcggctcgtggttggagttttcttgagaatagaatagaataatgtacctgtttataatattaacttcccaaaaccgcactggaggatcaccagggagaggattcggtgccttctcctatttggcgcgtaagataaatgttttgtctcatggctttcatgagaagatgaaattgactcatcttggtatatatttacaaatcttgaat

SEQ ID NO: 7653 - DNA, 1255 bp, Zea mays
ctcgagtcgagactcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgtaa

SEQ ID NO: 7654 - DNA, 3425 bp, Zea mays
ccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggccaaccttgctcccaaaaccaaggttctgagagatggccgatggggcgagcaagaggctgcaatcttggttcctggtgacatcatcagcatcaagcttggcgatatcgtccctgccgacgctcgtctcctcgagggtgatgcactcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctccattggggtcggcatcctcgtcgagatcatcgtcatgttcccaatccagcaccggaagtaccgcagcggaatcgagaacctgttggtcctcttgatcggtggtatcccaatcgccatgcctaccgtgctttcagttaccatggccattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaaggactgagaaccaggacgctatcgatgccgccatggttggcatgcttgctgatcctaaggaggccagggctggtataagggaaatccacttcttgcccttcaaccctgttgataagaggactggctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagtcccctggtggaccatggcagttcgttggtctgttgcccctgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatgctacgcttgaagcgcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgctcggatttatgctcattgcgttgatctggcaatacgatttctctcccttcatggttcttatcattgccattctcaatgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggtaaaaaaatacccactagccctttgcatcgatctcctcgatcggtagggtttttttcctgtctggttgttctcagcaccatgtcattgcgcaggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtggtctggctctacagcatcgtcttctacttccccctggacctgctcaagttcttcatccgcttcgtgctcagcggcagggcatgggacaacctcctcgagaacaagaccgccttcaccaccaagaaggactacgggcgggaagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctcttttcttattgttatgtttttcaatagtggagtgtgcgcgtgttgtaatcgtttttacctgcgttttcctctaactagccggtgatctcgcgggaagcgaggtgaagaaataatgcaactaaaattctctgcc

SEQ ID NO: 7655 - DNA, 1394 bp, Zea mays
cagggctgaagaagttggaggaatcgctgccagtggaaagcggcagcagcagaagcaagaaccagcaagaaaggggagagagaaagccgaaggacttttcctcggattgcatccttcgcttttgagggaaggagaaggaccctctctgtcctcgcggggggcggcaggaggagcagatgttcccgcctggcctgatccaccaccgccctgacgctaccgctcccggcgatgggccaccgcgctccggccccggtgggccgagccttgtactgacggcggaccccaagcccaggctacggtggacggccgacctccacgagcgtttcgtcgacgccgtggcccagctcggcggacccgagaaagcaacaccaaaaactatcttaaggacgatgggtgtcaagggtcttactcttttccacttgaagagtcatcttcagaaatataggttaggtaaacaatctgataaagaggggtcagagcaatctaaagatgcttcctatcttctagatgctcaaagtggaatgagtgtgtcccctagagttgctgcccaggatatgaaagagtatggttcatcagatgtttcttgtccagcatattattcttctttttaggcagactgagtactcttagcatatttgctgtgattgtgctatttgaaagagataatgtcatgatacttgctgcagaagccaagaagttaaagaagcactgagagcgcagatggaagtgcaacgaaggctgcatgaacaagtggaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgcacagtccaggaggcaaaccttctccatcaggcatggaaggtccgacactgctccagaagtcgcctgagctcaagcggaggtcctcttgaactgtgacagcgaattctgaggttggcggtgatggctgtctctgtggagtgtctgaatatggtggtgacaatggaaatggtggcccagtcttgtggtagctgactttctctccaggtagcaggacgtgctgtgtttgttgatcaatccaagtatcaaacggacctactatgttcatgtgaacttcctcaagtgctagttaaaaagttttcatgcttctgtcatgagattatgatcctagtagcatccttagcacacttgaaacgttgactcgtgtcctagtgtcgtttgtgttagtccatatgtgaacaatgattcatgttggaac

SEQ ID NO: 7656 - DNA, 1608 bp, Zea mays
gcattgaggacgttcgacctgccggaggcgcgaagaagttccagtctgctgcttactccaactgcgcaaagaagccatcctgatatcccttttggctttctcgttctagtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatgagtaagacgggtttctggtgtcgatttgcttctgagtttttttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaat

SEQ ID NO: 7657 - DNA, 1410 bp, Zea mays
gaaccgtctgctgttgcttggtgttgatgacatggatatcttcaaaggaattagcttgaagcttttggcgtttgagcagctcctaatgcagcatccggagtggcggggaagggtggtgcttgttcagatcgccaatccagcaagggggcggggaaaggatgtgagggaggtacaggaagagagcgatgcaatggtgaggcgcatcaacgacgcgttcgggcagccaggttaccagccggtgatactgatcgaccagcctctgcagttctatgagaggatggcttactatgtcgtcgcggagtgctgtttggtcactgcagtgagggacgggatgaacctgatcccatacgagtacgtaattgctcgacaagggaatgagaggatagatagtattctaggccttggtccggcttcaaggaagaagagcatgcttgtcgtgtcagagttcatcggctgctcgccctccctgagcggcgctatccgtgtgaacccttggaacatcgattcagtagccgacgcaatggactacgcgctggagatgccggaaggggagaaggtgttgagacatgagaaacaccacagatacgtgagcacgcacgacgtcgggtactgggcgaacagcttcctgcaagatcttgagcggatttgcctcgaccataacaggaggcgttgctggggcatagggtttgggctgaagttcagggttgtggccctcgacccaaacttcaagaagcttgcggtggagcacttggtcttggcctaccggaggacgaagaagcgtgtcattctcttagactacgatgggacgctgatgccgcagacttcgctcggtaagagtcctacctcaaggacgatagacatgttgaacagcctttgccgcgacaggaacaacatggtcttccttgtgagcgcaaagagccggatgactctgaacgaatggttcttaccatgtgagagccttggactagcagctgaacacggctgcttcctcaggctgagaagagacgcagaatgggagacatgcgttccggtgatagactgcagctggaagcagatcgcagagcctgtgatgaagacctataccgagactacggacgggtcgactattgaggacaaggagactgccatcgtgtggtgctacgaggacgccgatccagatttcggatcctgccaggccaaggagctccacgaccatctggagagcgtgcttgcaaacgagccggtctcagtgaaagctggacccaacctcgtcgaggtgaagccacagggcgtaagcaagggcctggtggcgaagcggatcctgtcgacgacgcaggagcggggcgacgccgacgacgacctgccggacttcgtgctgtgcgtgggcgacgaccggtccgacgaggacatgttcgaggtgatcgcggcggc

SEQ ID NO: 7658 - DNA, 1722 bp, Zea mays; identical to SEQ ID NO: 974

SEQ ID NO: 7659 - DNA, 2330 bp, Zea mays
ggaaacctctcaaaccctagccgcctcctgcaagtttcagagctcaggaatctgcgccatggcgagtgagacggagaccttcgcatttcaggctgagatcaaccagctgctctcactcatcatcaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagctcttgctgccggcgctgatgtgtccatgattggccagttcggcgtcggtttctactctgcctacctcgtcgccgatagagttgtcgtgaccaccaagcacaacgatgacgagcagtacgtgtgggagtcccaagcgggcgggtcgttcactgttactcgtgacacgtcaggggagcagcttggcaggggcactaagatcacactgttccttaaggacgatcagctggagtaccttgaggagcgtcgcctcaaggatctggtcaagaagcactctgagttcatcagctaccccatctccctgtggactgaaaagacaacagagaaggaaatttctgacgacgaagacgaggaagagaagaaagatgctgaggaaggaaaggttgaggatgttgatgagaaggaagagaaagaaaagaagaaaaagaagatcaaggaggtttctcatgagtggtcattggtcaacaagcagaagcccatatggatgaggaagccagaagaaatcacaaaagaagaatatgctgccttctataagagcttgacaaatgactgggaggagcatctggctgtgaagcacttctctgtggagggtcaactggagttcaaggctgttctctttgttcctaagagggccccctttgatctctttgacaccaagaagaagcaaaacaacatcaagctctatgtgcgcagggtgttcatcatggacaactgcgaagagctgatccctgagtggctgagcttcgttaagggtattgttgactctgaggaccttcccctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcaaggactacgtgaccaggatgaaggagggacagaatgacatatactatatcactggtgagagcaagaaggcagtggagaactcccccttccttgagaagctgaagaagaggggctatgaggttctgtacatggttgatgccattgacgagtatgctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctagctaagctacctgtgatagcttaattttcactattgttcgaggtttttggcacgttatcggttgtcctgctggccaggctataagtctggtttatctgttatgtttaccctttttaacagtttgtcgttattattcgt

SEQ ID NO: 7660 - DNA, 1021 bp, Zea mays
gaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacacagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgagggcgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggtggcggtggcgtcggcaacggcggcaccaagcgagcccgcccatcatagctgcgacttttagtgatgtaaactgcttagaaaaactgttgcggacatagcgcccatcatagctgcgactttttaaatggtggtgtaaacttttgtagtgcgactaggccgtttgtcaccctatcatacttggcttcaagtaggttttctgtttttcagttttcatt

SEQ ID NO: 7661 - DNA, 2308 bp, Zea mays
gcgagagctcccctctccctgtctcctcgtctgtgactgtgcgccgccatcgcccgtcgaccagcgccgtccgcccgctcgaaaactgagacgcacgctgcccgcgcatcgccgtggcctgctccagtctgtggaaaagtgacgaaccaactcggggaattctactctcgaggccgccacctccgcctccgcctccagccctccaccgactactgtctggaactggaagtgtaccactactattcaattggccctagccctcgcatagcacgatgccgccgccgctgcttgagttcgcgatcctcgccactgcctgcaggttcagcaagccccttaccgttctcaggaggcttggcgttcttggcccaccaaccgttcgacgcaatgccgcagaggcgttcgtgccttcaccgtttcgccaggttgtcgttcagagtggaaagcttcttgggacaccaaggttctgccacaccactgccggcatgtcagaatgtctcccggacgtctacgccagtcaggtactgaaggttctcaagtccaccagtgctgacaacacggatctcagcggtgctcttcatcagttcgcggtccacatggatgaggatattatcctcatggtcctccagaagcagcggtccaactggcaggtcgccctggcattcttcaactgggcggcaaccctgccggggtatgcccacgggtcaagggcctacaccgagatgctggacattcttgggcggatgaagaaggtcagacacatgaggcagctgtttgacgagattcctgaggagcgacgtcaggtggtcgtgacgaataagatgtttgccgtgctgttgaaccggtacgctggtgcgcacaaggtgcaggaggcgatagaggtgttctacttgaggaaggattacgggtttgagcttgacttggtcgggttccagatactactgatgtcgctgtgcaggtataagcatgtcgaggaggcggaggcgctgttccgtgagaagaaagatgagttcccgcatgtcacaaagagctggaacattatactaaatggttggtgtgtcaagggaagcctgagggacgctcaaaggatttggaatgatatcattgcatctaaggttgaacgagacctattcacctttggtacgttcataaacgcattggccaaaaatggcagaattagtgccgcggtgaagctgttcaaacagatgtgggagaaagggatcaatcctgatgttgcgatttgcaattgtatcatcgaccagctgtgcttcaagaaaaagattccagaagcacttgagatttttggtgagatgaatgaccggctttgtcaagccgatgtggctacctacaacactttgataaaatacatgtgtaagataaaaaggatggagaaagtttatgaacttttggatgacatggaagcaaagggctgccctccaaacaataggacatactcctacattctgaagacgactgagaaacccaaagatgtcattgccttgatgcagaggatggagcgaaccggctgcaaattggattctgatatatacaacttgatattgaacctttatatcaaatggaaatatgagaaggggatgcaacagatatgggatgagatggagagaagagggtcaggcccagatcagcggtcgtttactattatggttcatggtcttcattcccaaggcaagctcgatgaggctctgcagtattacacaacaatgaagtctagagggatgattccagaacctaggaccaagatactggtgaaagctatgcacatgaagaaggacggggctgccactgaagatgactcggcaagtatggcagggaagcatctaaaattggatcatcgttcaagactattcaatgttcatagatagtctgcttccaggtctttgttctataatctgagcaggggatgctgtccatataggtttatgggttgaaagaaagaaaaacagttcttttttctatgggtgtctaaatcacaatggctgcaccttgggctaaaaagaatcatcagcatagattcattggcaatatgatttctcagtaacttttgctcagactttcagtgccaggatcatcagtcagctgtgaaaacgttttcctagcaggtgaaattgggagttcaaggtgcgtaccgatatccaaatttatttaatgtgttgcgcaagaaacaaacaaatgtggtgggagcacttaaattctacaccttttaatgtggaatggcaaagttttatttattagattaaacaaggatatggatatttttatctagaacctaaataaaaacggcttgttctct

SEQ ID NO: 7662 - DNA, 1564 bp, Zea mays
atttctatgttattttactatactattgaaaaaatgagtaaattgtatgttgtgataatctgaacttttacatgacagactagcagatactgtcatggctcaggatgaagctgtggctacccaaaagactggaaatacaacatctccttctaaggattacccaactccttctccatatcctgattggtcaaccatgcaggcatattatggccctggtgtcttgccaccaacatattttactcctgcaatagctccaggtcatccaccgccatatatgtggggtcctcagcctataatgccaccccctttcgggacaccatatgctgcagtatacccacatggtggagcttacccacacccccttgtgcccatgatgtcaactccaatgagcgtggagccagccaaatctacaaatagcaaggagaaaaattccaataagaaacttaaggaaatagatcggactgcagtgtctgctggcagtggtaacagtaaaagaacagtgtcatccattgaagattacagtgcagaaggctcaagcgatgtaaacgatcagaatgtgaacgaaacgtccaggaagcggagctcagatggtggacctggcgcagaaaccaccacaggtggaaacacggaatgtgttttagctcctaaccatacgctggggaatgctaccattttgccacaacactgcttttcagctccagtaattaagcccagtgctacaaatgtcgcgaactcgagggcgataggcacagcattatctccaccacctggtgtgatggttccagttcataatgcagtaccatctgacttatcagttaaggatgagagggaattgaagcgcgaaaagaggaagcagtcaaatagggagtctgctagacgatcaaggctgagaaaacaggctgagacagaggagttggctacacaagtggagtctcttgcagcagagaacacgtcccttagatctgaaatcggccagctaacagagagctcagagaagctcagactagagaattcagctctaatggtgaagctgaaggacaccgcagaaccgtctccgattaaagcatccgcatccccgtcctctccccgtgcctccgcggagaacttcctttccatgatcgacagcgccaacgcgccgagcgtcagcaggcacacggagcacggcggtcccaggctccggcagctcctggactccagtccggcgacagacgtcgccgccgtaagctgatgatgaagccggtccggcaaatacgccacagcacatgcatgtgtcctggggattccgcaggctcatgctgctcgagtgctcgtcagcgttacggactcggactctgtactccagtttaggcactgattccagtgaagtaaccgagggtaccggtaattttatctgctctcgcgccagagtgccgggctgccttgcctgcgaccactcctgtcctgtgtacccagagttgtaacgtagtagggtgttgtgctgcatgccgaccttttgaaactttcgagaccgtcatttggaccatttttttcgtcgcagtaacacaatacagatcggagtttgtac

SEQ ID NO: 7663 - DNA, 780 bp, Zea mays
tcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgtactaatgttcccccatgttctgtttctcgttctgattctgcaattcgtcatattgttgaatttaatggttatgtggaatcgctaaaaag

SEQ ID NO: 7664 - DNA, 1934 bp, Zea mays
caaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgcgaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcatccttggacctggagactctttctagtttcatgtagttttagaaataagcgaacggcaagagtaccaatcttaggtgacttggtgtgggttgtgtctgaaataagtgaattggattgtagaatttcagaaataagtgaattggattgtagaatttcagaaagtgtgttccccttattttttcgctgc

SEQ ID NO: 7665 - DNA, 1111 bp, Zea mays
tttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccggcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtgcccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagcgggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaaccgaactcgtcctccacacggttgctttgccatctcggtggttttgtggtggtggtcgtgcttcctataggtgtgaggctgatggcgtggctgccatttatacaatctttaatcgtgttctgttgagctt

SEQ ID NO: 7666 - DNA, 1086 bp, Zea mays
gcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatctatttctctagatatccctacc

SEQ ID NO: 7667 - DNA, 1716 bp, Glycine max
aaaaaaaatttgattattattattgattttatttaactgttgttgttgttgttggagggtgatcgtagtttatgagtgagtgaggttaatggaatgtgaagagtgacgggacggtgatgatagtattgttacgcgtgtatggaattcgatgccgcgattcccgtttctcgagagcacctccctcaagatgcaatgtggcaaattaacttgaggtcaagtgaaacaatggaatcagaaccttatcctgagcatccaggagaaccagattgttcatactacattaggactggcctttgtagatttggagcaacatgtcgatttaatcatcctcctaacaggaagctggctattgccgctgcaaggatgaaaggtgaattcccagaaaggataggacagccagaatgccagtactatttgaagacaggaacttgcaaatttggagccacatgcaggtttcatcatcctagagacaaggctgggattgctggaagagttgccttgaatattttaggctatcctctccgcccaaatgaaccagaatgtggttattatttaagaactggacaatgtaaatttgggaacacttgcaaatttcaccatcctcaaccaaacaatatggtgctttccatgcgaagttctcctgtttatcctactgtccattctccaactacaccaggtcaccagtcatatgcgacaggaattacaaattggtctagttcatcgtatattcctagcccacgttggcaaggcccttcaagttatgcacctttaattctacctcagggaatggtttcagtgtctgggtggagtgcatacagtggtcaaatgggatcagacagtccacagcaaacaatggcaaatggccaaagctatggaacttctcgacaaagtgaaccagcaaattcaggatcccagggggcatattctcaatttcgttctggctctgttcctgtagggttctatgcgttgcagagggagaacatatttcctgagagacctgatcagcctgaatgtcaattctacatgaagactggagattgcaagtttggtgcagtctgtcgtttccatcatccacatgaaaggatgattcctgctcctgactgtgttttgagtcctataggtcttcctttacgtcctggagagcccctgtgtgtgttctattcacgttatggcatatgcaaatttggtccaagttgcaagtttgatcacccaatgggagtcttcacctataacatgtctgcatcacctttagctgatgccccaggacggcgtatgttaggttcttcatcaggaacttctgcattaaatttatcatcagaaggacttgttgagtcaggctcagaaaatccaaggaggctttcattatcagaaactcgacagataccttctggtgatgataacattgatgaagagggataatgatgtctcttggaaatgggtcatttgcttgttacaaatttttttcaggggagaaaaagggtaatctgtaaattgattttcccattgctgaagatgtacagactacagagttcatgtcaagctgattctgtcaaacctgctatttaatgcagttgagagattcagttgttctgaatttcatgctgtcacattgtataaattttacaaatatttgtcacatttggtgaaaacccaatgtgaacatttcttcagtctatctatttaatgttttcctaatatgtaaaaagtgtttttctg

SEQ ID NO: 7668 - DNA, 1919 bp, Zea mays
tttcagtctatgccagacatctacatgtagatggtgctcatataagtgggggttgatatatttgctgtgttcagcttacatctgttgcggccctagttagctatttgtcttttgtgtactatctgaggcaagagattgatcagctaggacttggcgaacacttgcctgtgttggctgttcatctgaaggggaaaatttgcacgagacacctcggatattacaacaatggatagattcaagttgattaaggaagttggcgatgggactttcgggagtgtatggcgtgctataaataaacagaatggtgaagttgttgctgttaagaaaatgaagaaaaagtattattcttttgaggaatgtatgggtttgcgtgaagtaaagtctttgcggcgcatgaatcatcctaacattgtgaagctcaaagaggttatccgagaaaatgatatattatacttcataatggaatacatggagtgtaatctctaccaacttatgaaggataaggtcaagcctttctcggagtctgaagtacgcaactggtgctttcagatatttcaggctcttgcttacatgcatcagaggggctactttcatcgtgacctcaaacctgagaatctgttagttagcaaagatgtcataaagctagcagactttggtcttgcaagggaagtttcatcattgccgccatatacagaatatgtctcaactcgctggtatcgggcaccagaagtattgctccagtcatctgcttatgattctgcagttgatatgtgggcaatgggtgccataatggctgagttgttgacactccatcctctctttcctggaaccagtgaagctgatgagattcacaagatatgcaatgtcatcggtagtccagatgagcaatcttggcctcaaggattgtcacttgcagaagcaatgaagtatcagttcccacagatcaaaggcagtcaactggccgaggtgatgacaacagccagtagcgatgcaattgatctcatctcatcactatgctcatgggatcctagcaagagaccaaaggccgcagaagtcctccagcataccttttttcagggttgtacatgtgttccacttcctgtccgtccaaaagcttcatcacttcctagaacacctccatgtgttggatcaaaaggaaattcagagaacagtgtggctagaagattctcaactggaactctatctacaatgaaatctcatagcaatgcatccgcaaaattaaatggtttatctaagactggtgtacaaagaaaacttaatttggatcgtcagccatcccaaaagggtatgaagccaaccgagactagcaataaactaactacgaatcgggtaccagctcggaatagcccagggaatcctgtacttaggcattcacggagcttgcctgaaactggccgaggagcaatacagaaggtctcatcaattacagagaaactatcccaaatgtctgtgacctctagaacacggagcgctgtgaagcctgctgcccccatgatgaaggccggacatggcaagtcggactttcttgggaagtctgacgatatccctccagcaaagaggctgacaagaaaattggtcagctaaatgagggtatgtggagtgaaaattcgatcagctgcaggaggggtgttgtgtatagtgtgcagaaaccagtgtgcccgaagaggatagtcagcctgagcgtttgcccatcgatggttgtgcggatttgccatcaccacagtttcgctgcgtcgagacatattagaatgggtttgcaaattcctttgtgaagtgctagagcctgcatcaagccttccccacttccgggcggttgatctgcttttttcctgcgaaaagcttgcccccatgttttaataaacatgattgtgctattaatttggtttggtttgccttgc

SEQ ID NO: 7669 - DNA, 583 bp, Zea mays
cgtttaccgccgccgacttctgattctaccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgtgtgggaatggatctctgttcgattgttc

SEQ ID NO: 7670 - DNA, 1266 bp, Zea mays
gaataataacctagctctgcacaccgcccagccaccagtggcagcaggagcaggggtcggaacaagatggtggggacggcagccggcagcgcggaggaggctgtgcggcggtgggtggacgccgccggagggcgcctcgtcctcgacggcgggctggccacggagctcgaggccaacggcgccgacctcaacgacccgctctggagcgctaagtgcctcctctcctccccgcacctcatccgcaaggtccacatggactatctggaagctggcgcaaacattataatcacagcatcgtatcaggccactattcaagggtttgaatcaaagggtttttcaaaagaacagagtgaaaacttactaacaaagagtgtcgagattgcactggaagctcgtgagatgttcttgaaggaacatctggagaagtccactcctatacagcacccggttctggtcgcagcgtctttagggagttatggagcttatcttgccgatggctccgagtacagtggggattatggtgaagctggtacgaaagagttcctgaaagatttccatcggcggaggctccaggttcttgcggaagcaggccccaatttgattgctttcgaaacgattcccaacaaactggaagctgaggcatatgtcgaacttctcgaggagtgcaacatcaatatccctgcatggttttccttcaactcaaaagatggagtgcatattgtgagcggcgactcgttaatcgaatgcgctactattgctgacaagtgtgcaaaggttggtgcggtcgggataaactgcacacctccaagatttattcatggactgatactctccattcgaaaggtcacggacaagcccattctgatatatcccaacagtggcgaaagatacgatggtgaaaaaaaggagtgggtggaatccactggtgtgtccgatggtgattttgtttcttatgtgaacgagtggtgcaaagacggggctgtgcttatcggtggctgctgcaggacaactccaaacactatcagggccatacacagaactctgaacaaaagccccaacaagcagcagttacctgctgtagaatagagctgtgctctactcctgatgcgcccgccttcctcctagcagtacctcgccttcctcctagcagtacctcgagggtatatccccatgattccttaaccgtacgtgtacgttctcttgcaaacgagatgtttgtaaataacgttgtatttctgggttgagatatgcaacttggatggaggt

SEQ ID NO: 7671 - DNA, 1988 bp, Zea mays
caggtttatgatagtacttgcagtagccaggactctgttccaggtttctatgtctctaatctctatgaagcggtacatgtttttgtctgtgccttgttggctttcactgctctgctgctcatctcctaactacgcctgcctgtttcctcccccgcaggattgatgagctcggcgagcttgagcaccagcatgcagggggcaatgaccagggtgagggcccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacatgtaagcgaagaaagagaggaggacgcaaaaagcaaaggcgaccgagagtgctgagtgctattgcctgggcgctagcttcagtagttcagttccatcatgcacatcgacatgataaaaaagccgcgtcggttctttccttttcggaatcttgattggcgctgctgcttgttgcctgttggcacagtcgggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaaggccagcctggccatgccgcgaaagccatgtccgcggtggccgtggcggctgcggctgctgctgctgctgctctggccggcgccggagctaccgctgctgctggccttgctgccaaccagcaccggcagccggggaagagctatgccacgggtgcgactgatccatgctctctgcaatatagcaggggactggcgaacaaactgtcgaacgagagcgaaaacatgcaggactctgacagtgtctcgatgctgacttccatgaacacaggaaacactgcaggcagcgtgtttccgttctcaaaacaaaacactgatcttttcgaagtgagcagctcaaggccagagtttggccttgttccatcggattcactgacgagttcacctcatagttccttgaagagtgtaaaaaatctgctcagctcacggagtctgagtgagcaccagagctccgcctccctgcaacactttgtggactggcccaggacgccacctgcccagggaggtctttcatggcccgaggcagaggacatgcccagagctcagacgtcacagctctcagtatccgctccaatggcatcctccgagctatcatcggcctccacatctcccatccacgaccacgagaagctgattctgtcacctctcaagctgggccgcgaccgcgagtatagcccatctggcctcgtcagcgctgcagcgaacagatacgaggttagccagctagaagcgacctgggcgacgacgttccgcgactcttcgacgggcggcccgttgggggaggttctggccaagaacaacagcaacgcggaagcaagaagttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagagccacggcgcctgctgcgatggtaccagcaacctgatggatgatgatctcggctcagttgtagtgagccaccccagcatccgcctcttgtgagcccgctgagttctggccatggaaaaagcgtgaggggttttgtcatttgagactgatctgtcacttgagttcttcttttgtttccttttaacctggctttgtaactctcaccttctttggatcgtgaaaagcgctgcgatgtgtggtgtggctgggtttttggtgcgccgttgatgcgtagtaccattcatat

SEQ ID NO: 7672 - DNA, 3184 bp, Zea mays
attggttttcctagtttttgtacataaacatttggtctatgcgttagtgtctctcacattatccgctatataacattacaattaagattcatctaaattctggtaatttgaaagcgacagaaataaaacttgtagatgaattattgtcttccataggtaacagtgaaaggatgaataacaaattaacaccagaaatctgaaaaacgaaataaaagtttaataagtgaagaaggatcgacaaggagaatgaataggaattaatctgtaccagagtgatgaaggatcgccgatagaatttgatgagaagaggcggcggcggcggagaggtctgtctgggctacgtacgtaggctcgtgggggcggctggattagccgaacggaagtcacgttcctcttttaatcgtacgaccactggctatttaatcggacggtcgtgcggccgttggacggctctgggtccaacgcgcgttggacgccccccgctccccctcctccagtcctcctctcgcttggacttggacgcgcgagctggctccgagattctgcccagttcttttcacgtttcggatgctccgtaaatgagtagtacgtataagcgacttgtgcaaattttggtccgggacagtgtgactacgcgagtaatggttcgggatccattccattattattgtagtgcttatgctagtagtacgtacttactccgtattattacgccgttcaaactgtcttgtgacgattcactgtcctgttcgtactaagctcgacggaccgttttccatcggactgaataattggatcccctgcgctgcgctgcgcctcacaaaccgcacacattattgggtgccacggcccaaaccggcgggtattattggccgccacaaaccaacgcttgtggcatgtgtcctgccgatcggacggctgggcgcgctcggccccgcggatccaacggcagggaaaggaaaccccatcagccgtcagcggctgccggctagcgccccactccgaacaagatagagccagccgcagctataaaaatgcacgccaccccccctcgccgtgtgtgtgtgtgtgtgtgaccgtgcgtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacacggtgatctcgatcgcggcgctggcggggctggtgcgggcggcgctggtgttcctggacctgcaggccgcgctgccgcccggggacgacggcggggaccaactggcggcgtcgggcccgggactggcagagcggttcctcagggccttccggccggcgctgtacgaggtgctggcgtcgacggcgacgacgtgcgaggcggacggcggcggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctccccgccgacgagacgccgctgctccgctacccggagttcgagtgatccggtcggtaaaaactaccaccccggtcccccaccccacccaccccccggcgagcggtgagcggtgacccccggtcgcgcgcgcctcggctgtgtgctgcaagttccgtgtggccttccgtgtacgcgtagcaaaccaaagaagaagaaaaaaaaaaggtgtaggagcagtagtagtggtgtagggttgctgtcgcttgcttattgctttcccctttcgcttcttgtattccccctcccattctctttgcgttttccgttccgtgctgtcgcctgtagcgtgtaaatactccggttcgcacttggcagcagaggcagagtgtagagtgctcccgtggccgccgtggctgtggctgatggtgtagcactttttacgagctcagctcgtgtagtacattgcatcctccttctgttcaattctcccgactggctaaaatatcgaggattgttttggaattggaacggttgtgtgtgcgtgcagtgcatactgtaataataactccacagcaaaaattacagcaaaatctgcagaattcatgtgcgaaacacgaaggcatcttctacgtacgggtgttccgattcgttgaaaggcacggattggttgggcgtttgcttagacggggctgcgacaggtcacatggacgacggcgtggtggagtggtacgtgcgtgggccccggcgtcgccgatggcacatgcggtcctcgcacccgaaaggaacctcgcgagcgtgcgtgcagtgcaccaggccaggcatcggaatggatcaagaccaaccgtactgcacgtctgcaccggaagccggaagggatgaacatgaaccccggaaaagaggcgtcacagtcacagcagcatggcggcagaggcacgatacacgacaggagaagcaccatagctacaagagcacaggtgcgttggatgaggacgcgcagtagccgccagttctcatccgatccacggtacgggggcatggcttttgtcgcatcgcgccgcgcgaggatttgcctccttcggccttcggggtgaagtcgaaccggtgcgccgaccgcggagtgagtgagcgagtgagcgagcgagcgcaggtccttgttgtcgctcgcacaccaccgtccaacagcacgcagtacgcgactgcgagcagcaagtttgttgcgacgtcggcttcagaccagaacgtcgcgttgtgcaggcaggcaggcaggcatatcatcagcgcctggcttggcttctccactccacccagccagcgtcatctgataaagcttggccggctggcctcgtccgacagacgaagcaagcaaagcaaacgcgcgttttttgcctgtgtggactttggagtgtagacacgccgcacgcagtcacgagcacgcacacgcacagtaagcagctggagataaacgtggttcgagttggatgggatcggaggcccccaagcaggaacgcatctcctgtctcgcgtcgacacgacacggcttgactcttgagcttgtgttgtgctttggtaaccgatcgtctgcttgctcagc

SEQ ID NO: 7673 - DNA, 1247 bp, Zea mays
acttggcgggcgaaaggcgaaaccgacgtgctcccgggcgggcggcgacagcggcatggagcgagagcggcaggcagtggcgaggaacaggaaggtggtgctgcgcgggtacatcgaccgcgcgcccagggaggaagacatggagctcgtcgacggcggcgccgtggagctgcgcgtccccgagggcggcggcggccccgcggtgctggtgaagaacctctacctatcctgcgacccttacatgcgcggcaggatgcgggacttccgcaactcctacatcccgcccttcaaacctggatcacctattgaagggtttggcgtggggagggtggtcgactccactcatccaggattcagtgctggtgacgttgtttccgggatgactggatgggaggactacagtctgatcaccaagcctgaacagctcaggaagatccagcaaagcgacataccactctcctatcatctgggccttcttggcatgcctggctttacagcttatgttggattctatgagatctgttcaccaaagaaaggggagtttgtttttgtttctgctgcatcgggagcagttgggcaaattgttggtcaacttgcgaagctccatggttgctatgttgttggaagcgctgggacagatcagaaggttgagctcttaaaggaaaaattcggatttgatgcggctttcaattataaggaagagcctgacttgactgctgccctgaaaaggcacttccctgaaggcatagacatctacttcgagaacgtaggcgggccgatgcttgatgctgtactactcaacatgcgagtacatggccgcattgcggtatgtggcatggtttcccagcacggggtgactgctcctgccggaatccacaacctgttctccttgataagcaagaggatagagatgaaggggttcatccagagcgattacgtgcacctgttcccgcagttcgtcgatgacatcaccaggcattacagagacgggaagatcgtgtatgtggaagacatgagcgttgggctggagagtgggccggcttccttcgtcggtctgttcagcggtaaaaatgttggcaagcaggtcgtctgtgtgtcgcgggattgaaaggcctggattttgttccctactggccagtacccttaaataaaatcaggaaaacattattttcaactccgagaaggaccccactagccagtaccacggtcgtaaatctcaaggtcatgtttattttttctcctgtatt

SEQ ID NO: 7674 - DNA, 794 bp, Zea mays
ccagcggatcgatcattcgatccccaccactgcccgaggccccctcctcgctgacttggctcctccgccgtggccggaggcgaagcaagtggggaccacagaagcattagctgggtgaactctttcaaaaggggcaggtgcgctagtttgaatggctgctacaaagcttcaggccttttggaaccaccctgctggccccaaaaccattcatttctgggcgccaacattcaaatggggtatcagcattgccaacatagccgactttgcaaagccgcctgaaaagatatcttaccctcagcaagttgctgttgcatgcactggaatcatttggtcaaggtacagcttggttatcacaccgaaaaactggaaccttttcagtgttaacgttgcaatggcgggtacaggcctgtatcagctttcacggaagattaggcaagattacttgtctggtgagaaggatgctgctccacaactgcaagaatagataatgacaacacacaaagaataactgattgagaagtctgcggcctagggatcttactcttgatttttctgggcaggcaaggatatgtctacatccaggacgggtcatgtttgttttcttgttcttctgaaatcatgagcaggtcaatgtgaaaatctcctgccaaaaaaagaagcccatgaagtaatattttgtgcatttttgtgggaaaaaagtcatgccaggacatgattcgtatattgtccttttgttcactctatctcgtatttgtgaactctaaattgtttgccaatttgattgatcatagccc

SEQ ID NO: 7675 - DNA, 1529 bp, Zea mays
agaagcttcaatcaaccaatttctgttggaatgaggtgcagaatgcgatatgaaagtgacgatgcttctgaaagaaggtgcactggtataataattggaagcagagaagctgatcctatatggtatggttcgaaatggaaatgcttggtggttagatgggatgatggtatagagtgccgttggcccaatagggtatctccttgggagattgagctcacaggatctgtttcaggatctcaaatgtgcgctcccagttcaaaacgtctgaaaccatgcctcccccaagttaatccggagattgtgcttccaaatggaagtgtttcttcagattttgcgggatctgccagattccacaaggtcttgcaaggtcaagaattgttgggtttcaaaacccatgatggtcctgctatttctgcttctcaggcaactgaagcaagaaatttgcagtacagtgatgaacggagtaacaataacttagggatcccaagacttggtgttaggtctccaactggaatccctgggtttccctaccattgctcaggctttggggaatctcaaagattccaaaaggtcttgcaaggtcaagaagtgtttcatcctttccgaggaggatgtttgtctgatggccatataagaactgctggcatgtatcaacctgacggtaggcatgtatctggtgcagcttataaatggtctgcaccacaagggtatgatttcccacagccagcaaaaccgttttttctgttgcaagaatcatccccatcatctgtgatgatgtttccacaaactagatctaagataactcacttggaatatgagtactcaagacatgaggatggtagacttgataggactgttcctactcaagacatgggaagaagcaatcaaacattatctctttggcctcatcttgtttcaggcgaagcaatagaagaatgtactggaactgtgaatatgcactcccccgtcagtggtgcagagcatgaatcaaacaatgagagtacagttgaaaatggctgcaaaatctttggtatctcattggctgaaaagatccgatcatgcgatgaagcagactcttgcagtgcaaaatgtaattctcggctccagcctttgaagtcacaaatgccaaaatcgctaggcagctgttgggccactgttcacgagcaaaggcctgttgttggcagggtggttgacgtctcggcgacggatatgatgatctgatccacatggcatatccttgtagaatatgcaggaaggactaccgagtgcaactttcatggcctgaaccacatcctggatgaaagattgctgaaggtgaccttatgattcttgaaacagggatgtttgacaaatttgtaatgtacttttgggctttaagtatcttattatcttaagctacctagtaatcagcacttgtaccttaaggtgtgcgttatggcaagttcttttagagggcttgtttggactagcaccatctcccaagtactcgtcgcattgtttctttgccccgggaaacaagtccgttttgg

SEQ ID NO: 7676 - DNA, 876 bp, Zea mays
ggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggtcaaaccataatgtgtagtatttgtgtcgaactgtcaatggcacgtatttggattttcactacacgttacatatgaagggat

SEQ ID NO: 7677 - DNA, 1294 bp, Glycine max
attactccctatattaacccaacaatgcaaaacaacacactgaactctcttcactgaaacgacacacacaaaaaaaagctttagtttaggatgacccaagtgaggaacaagcaagtggttctaagagattatgtcaccggattccctaaagaatccgacatgaacattgttgaaggcaccataatattgaaggttccagaaggttccaatgatgtccttctaaaaaatctctacttgtcatgtgatccatacatgcgactcctcatggccaaggaccgttctttcggagatggctccttcacccttgcctctccattgaaaggatatggtgtgtctcaagtgctggaatctggacgtccagattacaagaaaggtgatttagtgtgggggattactaaatgggaagagtatagcttggtcccctcatctctcatacatttcaaaattgagcacactgatgtcccactttcctactacactggaattcttggtatgccaggaatgactgcttatgctggtttctttgaggtaggttctcccaaaaaaggagacactgttttcgtttcagctgcctctggtgctgttggtcaacttgttggccaatttgctaagttgactggttgttatgttgttggaagtgctggaagtaaagagaaggtggatctgctgaagaataaattaggatttgatgaagcttttaactacaaagaagagccagacctcaatgcagctttgaaaaggtactttccagaaggcattgacatttactttgagaatgttgggggcaagacacttgatgcagtactcccaaacatgaaatttcatggccgcatacctgtctgtggaatgatctcgcagtacaatcttactcagttcgatggtgtaacaaatttggcaaatctcatatttaagcgggttaaaatggaaggttttattgcaactgatttctatcatttatatccaaaattcttggagtttgtcctgcctcatatcagagaagggaaggttgtgtatgtggaagacattgctgagggccttgagaagggccctgcagccttggttggcctctataccggtcgcaatgttggtaaacaagtggttgttgttactcacgagtaaaattatataaatatattgttattctctaagctttaattccgaattttcaattttctgttggatattgaaccttgcttttatggtttatgcagtcattcttctattttgttgatagaaattactacattagtgacattttgtgataaataaaacctctaatatatgctaatttgtt

SEQ ID NO: 7678 - DNA, 1807 bp, Glycine max
cggttttgaatcttttgagcgaaaatgcagtcgagtcctttgcttctggaggaacccataaggatggcctccatcctcgagccatccaagcctagtttctttccagcgatgacaaagattgttggcacacttggcccaaagtcacgatcggttgacgtgatttcccaatgtcttgaggcaggaatgtctgtggcaaggtttgatttttcatggggtgatcctgaataccaccaagagacgttggaaaatttaagggctgctatcaaaagtaccaagaaactttgtgcggttatgctagataccgtgggtccagaactacaagttgtcaacaaaactgagcacccaatttcccttcaggctgacacattggttgtcttaactcctgatcagaacaaagaagctacttcaaatcttttacctgtaaattttagtggactttcaaaggctgtgaagaatggtgatactatttttattggtcaatacctgtttactggaagtgaaacaacctcagtgtggctagaggtcagcgaagtgaatggtgatgatgtcacttgtgtcataaaaaattctgctactcttgctgggtcactgtatactttacatgtctctcaaattcatatcgaccttcccactcttgacaataaggataaggaggtaataagcacttggggtgctcaaaacaatatagacttcctttcattatcatacaccaggcacgctgaagatgttcaccatgctcgtgagtttctctctaaactaggtaacctcaaacagacccagatatttgcaaagattgaaaacatagaggggttgacacattttgatgagatattgcgagaagcggatggtatcatcctctcacgtggaaatttggggatagatcttccacccgagaaggtgtttttatttcaaaaagcagctatttacaaatgtaacatggctgggaaacctgctgttgtcacacgtgttgtggatactatgaccgataacctaagacctactcgtgctgaagcaactgatgttgccaatgcagtgttggatggcagtgatgcaattgttcttggggcagaaactttgcgggggttataccctgtagagactatttccactgttggaaaaatttgtgctgaggcagagaaagtttataatcaagatttgtatttcaagaaggctgtcaaatttgttggagagccgatgactcatttggaatcaatagcttcctctgcggtacgggcagccatcaaggttaaggcttctgttattatttgctttacttcatctggcagggctgcaaggttgattgctaagtaccgtccaaccatgcctgtgatatccgttgtcattcctcaactaaagacaaatcaacttcgatggactttcactggagcttttgaggcaaggcaatcacttattgtgagaggtcttttccctatgcttgcagatccacgacatccagctgagtctaaaagtgcaacaaatgaatcaattttgaaggttgctttagaccatggcaaggcttttggtatcataaaggcacatgatcgagttgttgtatgccagaaagttggtgactcctcagttgtgaagattattgagcttgacgaatagaacttgattcattttcaagtttgcgttataatatgtcttctttgtattagtattttctgttgtatgctttaataataaaaacacttcaaaataatgtgtatcacattggaagaaatgcttttggggaatggatatcattcattgccagcatgccaactgttgtttataatataacaccattgaatccttttatcaaaaa

SEQ ID NO: 7679 - DNA, 1396 bp, Glycine max
aacatacacccacatatttcatatgggtacttgttaatttgggtgtggattgttggtttgttacttgttttgttccgttcaggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgtcagcaaggctggtcttgctaaacttattggactcgctggagaaaccaatgttcagggtgaagaacagaagaaactggatgttctttccaatgaggttttcatcaaggctctcataagcagtggccgaacatgcatcttggtttctgaagaagatgaagaagcgataattgtggagccttctaagcgcggaaagtactgtgtttgctttgacccattggatggctcgtccaacattgattgtggggtttccattggcacaatttttggggtttatgcgttgaaagatgtccatgaaccaaccatagaagatgtcctgcttcctgggaagaacatggtggcagctggttactgtatgtatggaagctcttgcacgcttgtgttaagcactggagcaggtgttaatggtttcacccttgacccatctcttggtgagttcatcctaactcaccctaacattaagatcccaaagaaaggtaaaatttattcagtgaatgaaggaaatgccaaaaactgggatcgtcctactgctacttacgttgaaaaatgcaagtttcctgaagatggttcatcaccaaagtctctaagatatattggaagcatggtagctgatgttcatcgtacgttgctttatggaggcatctttttgtaccctgctgacaaaaaaagtccaaatggaaaacttcgtgtcctgtatgaagtcttcccaatgtcattcttgatggaacaggcaggaggacagtctttcacgggcaaggaacgggcacttgatttagttccaacgaagttgcacgagcgatctcccatattccttggtagctatgatgatgttgaggaaatcaaagctctttatgctgctgctgagggtgaacaagaatgaaattggaaaggtttcttgtatctttcgctacttacaagcgcttgttttctaattgttactagcaggtgcttataagaaaactagttatctggtcatgtatatgttaataaaattggttgatgtgcctgtcagggctatagaatttatttagataaaatacttagattaaagtatcattttgttgctgaagaagtataactgcttactttccctcaagatgcatttcaaagttaaatccgcagacctgttagttactat

SEQ ID NO: 7680 - DNA, 1669 bp, Glycine max
ggaaacgtatagaaaaagcttttccaagaattggcaaaaagagaagaagggagagagattcatgttcatattttccccttcgtgcccgtcaagtttctgattctctttttcaattcctttctctttcaggtgattttttctccacgataaagttgcgatttcgccggtgtcgttttgccgcaagatggtgtcgttttcgggaatataaaatcagggttgaagttctttcttcagcattgaatctttggttacataggttggtttctttagaactcgattcaatttcaaataattggtcctccctttttgtggaactcaattctattaggttagtggaaagagaaaaaaaaacatggttgaatcaattgctgcaacttcactccttggccaccgtccaatttgtggtggaaatttaaccagggatgtatctgttaaacgcaaatctttgaatactgttcggttcccaacaactgagtttcttggtggtggaaggattgtggtttctctggctttgcctaaatctgataagcaagataggtttgtgttttcatcaattaaggccttggctgtggagttaacaagagaagcacatgcttatagggaagagaaattgcccaacagggataccaagattgatcgtggatttgatcaaaggcctgattcgtggcctcctgcgaatagggcagataaaccgtcgcttcggaatccactactccgtcatgagaggatgggatgtggttggttgggtgctatatttgagtgggagggtgttctaattgaagacaaccctgatttagagaagcaggcttggctggcactctctcaggaagaaggcaaaccctctcctcctgcttttatcctcaagagaatagagggcatgaagaatgaacaggcgatttcagaagtgctgtgttggtctagggatccggcacagttgagaagaatggctaatagaaaggaagaaatctaccaatctttgcagggtgggatatataggttcttgtctggatccaaggagtttgttagtgttttgatgcattataagataccaatggcattggtttccacgcggcctaggaaggctcttgagtctgctataggggagattgggattgaggacactttcagtgttattgtagcagcagaggatgttcataggggaaagcctgatccagaaatgtttgtgtatgctgcacagcttttgaacttcatacctgagaggtgcattgtgtttggtaactccaatctaacagtggaggctgcacatgaagcgcggatgaagtgtgtggctgttgctagcaagcatcctgtatatgagcttggggctgcagacttggttgtcaggcgcctagatgagctttcagtggttgatttgaagaatcttgcagacattgaaatgactgaatttgggtctgtggagcctgagatggagctggaggtggaaaaagattatggctcatcatcagttgatgacaatttctggtaaatcctataatgtacagttgattgaacctcatctgattgttgatgatattagttacaggttagttacttgtgtatatggtaatcagaataaatggggggaaaaaatgataagtggtatgcattgaacattgatgttactactaatgcattttctgttcatatacattcacgaatttttagattt

SEQ ID NO: 7681 - DNA, 1693 bp, Glycine max
gaatgagtggcggaggagaagagggagcaactctggagttcactccgacgtgggttgtggccgccttttgcacagtcatcgtcgccatttccctcgccgctgagcgcctccttcattatggcggaaagtttctcaaagccaaggaccagaagccgctctacgaagctctccagaagatcaaagaagagctgatgcttttggggttcatttccctgcttttgacggttacacaaaacggcattaccaaaatctgcgttcgaccctctttgacgctccacatgctcccgtgtaatctccacgacgctccagcaaaccacgaatctcatttccagacatttttccctggaacagccaggcgccttctctctggggaacactccacccccgagtccgcctctaaaattggttattgctctcgcaagcacaaggtgcctttattatctgtggaagcacttcaccaccttcacatcttcatttttgtcctcgctgtcgtacacgtctccttttccgtgctcaccgttgtctttggaggcgccagaatacgtcagtggaaacactgggaagattctattgcaaaacagaactacgagactgaccgagttctcaaaccaaaggtcactcaggttcaccagcatgattttatcaggggtcgttttgctggttttggcaaagactctgctatagtcggttggttgctatcctttctaaagcaattttatggatctgtgacaaaatcagattatgtgacattgcgacatggtttcattatgacccactgcaggacaaatccgaagtttaattttcacaagtacatgattcgtgccctcgaagatgatttcaagcaagttgttggtataagttggtatctttggctctttgtggttatcttcttgttacttaatatcaatggttggcatacgtatttctggattgcttttattcctgtcattcttttacttgctgtgggcactaagctggagcacataataacccaactagctcatgaagtagctgagaagcatgctgccatagaaggtgatttagttgtgcagccatcagatgatcacttttggtttcaccggccccgtgttgtcctctttttgattcactttatccttttccaaaatgcttttgagatagcattttttttctggatatgggttacatatggatttgactcctgtataatgggacaagttcgatacattgttccaaggcttgttattggggtatttattcaggtactatgtagctacagcaccctgccactgtatgcaattgttacgcagatgggaactcactataagcgggcaatatttaatgatcatttgcaacaaaacattgttggttgggcacagaaggcgaagaagaggaaaggactaaaagctgatggcaatcctggccaaggaagttctcaggagagtgctaatacaggaatccagcttgggtcaattttcaagaaggcaactgctccaggagacagttcttctgcccccaaagctgacggaatcagctcagtgtagctatttaagtgaagatttacagtcttattttgtaaagttgctcacagattgcagttttctttatattattttctttgctaacataatgtagcattgtgggacatgtgtttgacttggtgtacgcataaggtcgaagtactatatgagtagatgctagtaatgctattgtc

SEQ ID NO: 7682 - DNA, 1439 bp, Glycine max
caagttgtcaacaaaactgagcacccaatttcccttcaggctgacacattggttgtcttaactcctgatcagaacaaagaagctacttcaaatcttttacctgtaaattttagtggactttcaaaggctgtgaagaatggtgatactatttttattggtcaatacctgtttactggaagtgaaacaacctcagtgtggctagaggtcagcgaagtgaatggtgatgatgtcacttgtgtcataaaaaattctgctactcttgctgggtcactgtatactttacatgtctctcaaattcatatcgaccttcccactcttgacaataaggataaggaggtaataagcacttggggtgctcaaaacaatatagacttcctttcattatcatacaccaggcacgctgaagatgttcgccatgctcgtgagtttctctctaaactaggtaacctcaaacagacccagatatttgcaaagattgaaaacatagaggggttgacacattttgatgagatattgcgagaagcggatggtatcatcctctcacgtggaaatttggggatagatcttccacccgagaaggtgtttttatttcaaaaagcagctatttacaaatgtaacatggctgggaaacctgctgttgtcacacgtgttgtggatactatgaccgataacctaagacctactcgtgctgaagcaactgatgttgccaatgcagtgttggatggcagtgatgcaattgttcttggggcagaaactttgcgggggttataccctgtagagactatttccactgttggaaaaatttgtgctgaggcagagaaagtttataatcaagatttgtatttcaagaaggctgtcaaatttgttggagagccgatgactcatttggaatcaatagcttcctctgcggtacgggcagccatcaaggttaaggcttctgttattatttgctttacttcatctggcagggctgcaaggttgattgctaagtaccgtccaaccatgcctgtgatatccgttgtcattcctcaactaaagacaaatcaacttcgatggactttcactggagcttttgaggcaaggcaatcacttattgtgagaggtcttttccctatgcttgcagatccacgacatccagctgagtctaaaagtgcaacaaatgaatcaattttgaaggttgctttagaccatggcaaggcttttggtatcataaaggcacatgatcgagttgttgtatgccagaaagttggtgactcctcagttgtgaagattattgagcttgacgaatagaacttgattcattttcaagtttgcgttataatatgtcttctttgtattagtattttctgttgtatgctttaataataaaaacacttcaaaataatgtgtatcacattggaagaaatgcttttggggaatggatatcattcattgccagc

SEQ ID NO: 7683 - DNA, 1159 bp, Glycine max
ggccatcgcaacagagactcagcctcaacaacacaaggattcttcggaggtttcgggttcagctgcggagcaaagaaggtggacgcttaacgatttcgatatcggaaagcctcttggaaggggaaaattcggtcacgtctatttggccagagagaagactagtaatcatattgttgctttgaaagtactcttcaagagtcaattgcaacaatcccaagttgtgcatcaacttcgacgtgaagttgaaatacagagtcatctccgacatccccacattttgcgcctctatggatacttttatgatcagaaacgagtttatttgattttagagtatgcacccaaaggtgaactttacaaggaattgcaaaaatgcaaatatttcagtgaaaggcgtgcagctacttatgttgcatcattggcccgagcccttatatattgccatggaaagcatgtaatacatagggatattaaaccagagaaccttcttattggttcacagggtgagttgaaaatagcagactttgggtggtcagtgcacacattcaatcgcaggcggaccatgtgtggcacactggattaccttcctcctgagatggtggagagtgtagaacatgatgcgagtgtggatatatggagccttggtgtcttgtgctatgagtttctttatggagtccctccttttgaggctaaagaacattctgatacttacaggaggataatacaagtggatctgaagttccctcctaaaccaattgtgtcttcagctgcaaaggatctcattagtcagatgctggtcaaggattcctctcaacgtctaccattgcacaaactcctcgaacacccttggattgttcagaatgccgagccctctggtgtatataggagctagtgcaccttatcattcttatattgtattttcttaatcgtggaaatcatcaaaatagcagctgcttctaagtatttgacaacattttggttttgagatgatgcaactatttgaagtaggttgctaggttaagagaaatcacttgttatatgattgtaaaccctactccttcaagggctatataaagaataactgatgtcacttgttatttgattgtaaaccctactccttcaagggctatataaagaataactgatgtcacttgttgattgt

SEQ ID NO: 7684 - DNA, 1635 bp, Glycine max
cttctttccaaatcccaactactactcacactcactgcagatctcaatccatggctaccattgttagcatcaaggcccgccagatctttgacagtcgtggcaatccaaccgtcgaggtggatttgacatgctccgatggtacttttgctagagctgctgttccaagtggtgcatccactgggatttatgaggcccttgaattgagagatggaggatctgactaccttggaaagggtgtatcaaaggctgttgacaatgtgaacaccattattgcccctgctttggttggcaaggacccaactcagcagactgctattgacaacttaatggttcaacaacttgatggaactgttaacgaatggggttggtgcaagcaaaagcttggagcaaatgccatattggcagtgtctcttgcagtctgcaaagctggtgctgctgtcctgaaagttcctctttacaagcatattgcaaatattgcgggtaacaaaaagttggttttgcctgttcctgctttcaatgtcattaatggtggatcacatgctggaaacaaacttgctatgcaggagtttatggttcttcccgtgggagcttcctctttcaaggaagccatgaagatgggtgtagaagtatatcacaatttgaagtctgtgattaagaagaaatatggtcaagatgcagtaaatgttggtgacgaaggtggctttgcccctaacatccaggaaaacaaggaaggtttggaattgctgaaaactgccattgccaaagctggttacacaggcaaagttgtcattggaatggatgttgcagcttctgaattctacaaggaagataaaacatacgatttgaacttcaaggaagataacaatgatggctcacagaagatctctggagatgctttgaaagatctatacaagtcatttgtgacagagtatccaattgtttcaattgaggatccttttgaccaggatgactgggagcactatgctaagcttactgctgaggttggaaccaatgtacaaattgttggtgatgatctcttggttaccaaccccaagagggttcagaaggcaattgatacaaaagcatgcaatgctcttctccttaaggtcaaccaaattggttctgtgactgagagtattgaagctgtcaggatgtccaaaaaagctggatggggtgtcatggcgagtcacagaagtggagagactgaggataccttcattgctgacctttctgttggtttggcaacgggtcaaattaagactggagctccatgcaggtcagagcgtcttgctaaatataaccagctcttgagaattgaggaggagcttggtgcggaagcagtgtatgctggagctaacttccgtacccctgttgagccctactaaagttttcaagtggaaaaaacctggagatccccacgagtttgagcaatgagatttggatgcgcggttttagttgtgatcaataagtcgatagttagaacaatagtcttggtataaggaccttgccaataattttttagttctgattcacagagctaagacagttccgtcttagactttaaaagttttgatatttagctttaatacttgaagtttacttccaattttatggggtatccccaaaacatttcat

SEQ ID NO: 7685 - DNA, 498 bp, Glycine max
tgatcttctactctctgggtatggcattgtccaaggatatatctgacgttaaaggagataaagcatacggcatcgatactttagcgatacgtttgggtcaaaaatgggtattttggatttgcattatcctttttgaaatggcttttggagttgccctcttggcaggagcaacatcttcttacctttggattaaaattgtcacgggtctgggacatgctattcttgcttcaattctcttgtaccaagccaaatctatatacttgagcaacaaagtttccactatatcgttttatatgttgatctggaagttgttgtacgcagcatactttctcatggctttaattagataaggatgttgaggaaggttaaagcaatgttcatagcacatttggcagaataaaaagaatatggtatgcatctaaatttattaaaacaataaaaactgtagagatgtgtgtaccctggatagtaatttgcgaaccattaaactcttttttt

SEQ ID NO: 7686 - DNA, 2137 bp, Glycine max
gaaaggaaatatgccgttacctctataatcatcaaaacaaggatggtgggtggggtttgcatattgaaggtccaagcaccatgtttggctctgtcttgagttatattactctgagattgctaggtgaggggcctaatgatggacaaggggaaatggagaaggcacgtgactggattctagggcatggtggtgctacttatataacgtcatgggggaagatgtggctttcagtacttggagtgtatgaatggtctggaaataatcccctgccccctgagatatggctccttccatacatgcttccatttcatccaggaaggatgtggtgtcactgccggatggtctatttgccgatgtcctacttatatggcaagaggtttgttggtccaatctcaccaacagtattatctttgagaaaagagctttatacagtaccataccatgatatagattgggatcaggctcgcaatttgtgtgcaaaggaagatttgtactatcctcacccacttgtacaggatattctttgggcatctctacacaagttccttgagcctattctgatgcattggcctggaaaaagattgagggaaaaggctattatttctgcattggagcatatacattacgaagatgagaatactcgatatatttgcataggtcctgtaaataaggtgttaaatatgctttgctgttgggtggaagatccaaattctgaggccttcaagttgcatcttcccaggatttatgattatctatggattgcagaagatggcatgaaaatgcagggctacaatggaagtcaactatgggacactgcttttgctgtccaagcaattattgcatctaacctcattgaagaatttggtccaactataagaaaagctcatacctatattaagaattcacaggttttagaagattgtccaggtgatcttaataaatggtaccgtcacatttcaaaaggtgcttggcctttttcaactggagatcatggatggccaatttctgactgcacagctgaaggactgaaagctgttctattactatccaaaattgcaccagaaatagttggtgagccaatagacgtgaagcgattatatgattctgtaaatgtcattctctcactacagaatgaagatggtggttttgcaacatatgagcttaaacgatcttataattggttggagataatcaatcctgctgaaacttttggtgacatcgttattgattatccttatgtggaatgtacatcagcagcgattcaagctttggcatcatttaggaaattatatcctgggcatcgccgagaagaaatacaacattgtatcgataaagccactaccttcattgaaaaaatacaagcttcagatggatcatggtatggttcttggggagtttgcttcacttacggtgcttggtttggggtaaaaggtctgattgctgctggaaggagtttcagtaattgctcaagcatccgtaaagcttgtgaatttctgctgtccaagcagcttccttctggtggctggggagagagttatctgtcctgtcaaaacaaggtgtattcaaatctggaaggcaacaggtctcatgtggtcaacactgggtgggctatgttggctctcattgatgctggacaggctaagagagattcgcaaccactgcaccgggcagctgcatacttgataaattcccaattggaggacggtgactttccgcagcaggaaataatgggagtcttcaacaagaattgcatgatcacatacgccgcatacagaaacatattccccatttgggcgttgggagaataccaatcccaagtattgcaatctcgttaatcgagccttagttagggtgtcatcctaattatttcgacctgtggacagtaaaagaaataataataataacctatttttcttttatttccatggctctcttaaaatgtttgtgactaatgagtttagtagtcagctaaaaaaaaaagcaaacacgtggagaatgcctgtaagttttttctattactcatagacgcctctcttgctttccctgcagcagaggaattaaatatatacataaatagagatataaatgtttatgtcacttcttttgggacgaagaacgcaattctttctagcaatcg

SEQ ID NO: 7687 - DNA, 1302 bp, Glycine max
ctcattctcattcgttcactgtcactttacccaatcctaacactttcttctctctgttttccttcttcctcgcatcaatggagttggacggcgttctcctcggcatgtgcaaccctctcctcgacatctctgccgtcgtcgacgacgctttcttgcaaaaatacggtatcaagttgaacgatgcgattctcgccgaggataaacacaaacctatgtatgaagaattggctaacaatcctaatgtggagtacattgctggaggtgctactcagaattcaatcagggttgctcagtggatgcttcaagcaccaggtgccacaagttatataggttgcataggaaaggacaaatttggagaggagatgaagaagaaatgtacactagatggtgtaaaggttaactattatgaaatcgacaatacacctacaggaacttgtgctgtttgtgtggttggtggtgaaaggtcccttgttgccaacttatcagctgcaaattgctacaagtctgagcatttgacgagaccggaaaattgggcattagttgaaaaggccaagtattactacatttctggctttttcctcactgtatctcctgattccatacaattggttgctgaacatgcagctgcaaataacaagatcttcatgatgaacctttctgctccctttatatgtgagttctttaagggtgcactggacaaagttctgccatatatggattatgtttttggaaatgaaactgaagcaagaacattttctaaagctcaaggctgggagactgataatgttgaagaaatagctttaaagatttctcaattgccaaaagcatcagaaaaacataaaaggattactgttatcacccaaggtgcagatcctgtttgtgtcgctgaggatggaaaagtaaaattgtatcctgtgatactattacctaaagagaaattaattgatacaaatggagcaggagatgcttttgtgggaggatttctttcgcaattggttaagcagaagcccattgaagaatgtgtgagagctgggtgttatgcagccaatgttatcatccaaaggcctggctgcacatacccagagaagcctgattttcattaagtgatttctccttttctgttactgctatgaattattattattattttttatcattgagaagaattttaacagccacactctaactggtgtggggttttttaatcccccgtctagggaaaacaacgtgaaaaagttgcaggaaaagagataaaacttgaataagttcatatatttgaagtccgatcaggcatcaattctc

SEQ ID NO: 7688 - DNA, 1608 bp, Glycine max
tttgggtctgtttttgcgttgcagacatcccacacacaacacattcacaacacaacatttgatttctctcttttgtcatcctcaaaatccacaatctttcctccttaatatctccgaccccaacaaaaagaaacaagcaagccatggattcccagatccatggcttgtcctcgtaaagtcaacccctttaccagtcaaacttaaccccccttctctccccctctgaaaccgcaggaagaagatcaaatcgaagaaggcttaaaaaaaatgaagggttcgaacaaccggttcttcacggtggcgctggtggcggcgtggtactcctcaaacattggggtgcttctcctgaacaagtacttgctcagcaactacggcttcaagtacccaatcttcctcaccatgtgccacatgacggcgtgctccttgctcagttacgtcgccatagcgtggatgaaggtcgtgcctttgcagagcattcgatccagggtgcaattcttcaagatctctgctctcagcctcgttttctgcgtctccgtcgtgttcgggaacatttccttgcgctacctccccgtgtcgtttaaccaggctattggcgccaccacgcccttcttcaccgccgttttcgcttaccttatgaccttcaagagggaggcttggctcacttacctcacccttgttcctgttgttactggagtcatcattgccagtgggggggaaccgagtttccatctgtttggatttattatatgtgttgcggctacagctgcaagggctctgaaatcagtgctacaagggattttgctttcttctgaaggagagaagctgaattctatgaaccttctcctttacatgtctccaatggctgtggttttccttcttcctgcaacacttataatggaagagaatgtggttggcatcacgttggctcttgccagagatgattccaagatcatttggtatctgctgtttaattcagcacttgcatattttgtcaacctgaccaactttttggtcacgaaacataccagtgctctaacccttcaggtactaggaaatgctaaaggggcggtagcagtagtagtttctattctaatattcagaaacccagtgtcagtcactggaatgatgggttactcactcacagtctttggagttatactctacagtgaagccaaaaagagaagcaagtgatactataatgcatcatcattcatgctctcggctgcagtgaaaggacaacctttagttataccctacaattacaacatttagttttcgttactgcacagtcaacctcaagatttctgaaggaaaatttgtttagcatgctagtgatcagaatccagagttttctgactataatatacattttttttacccacacgccagacctcaacgagtttctcgttgtattagcaatgatcgatgcagaaatagcccacagaacaaaattgctataaatgatgtctctctactttacctgtgttgggataattgagtactttttgtcatttattcttggaggaaagagttgtaaaattggatatctacacatctattgttcaactctatttacattcgtttattaatgatagaattcatactttt

SEQ ID NO: 7689 - DNA, 1298 bp, Zea mays
tccaagggccaagggaggctgcaggcaggttgtctccctccttcccacctgcaccacccctacccctgccccccatctcatccatcaatgggaaggtcaccttgctgcgatgagaatggtctcaagaagggcccctggacccctgaagaagaccagaagctcatggagtacatccagaagaacggccatgggagctggagggcgctgcctaggcttgccgggctcaacaggtgtggcaagagctgcaggctgagatggaccaactacttgaggccagacatcaagagagggaagttcacccaggaggaagaacagaccatcctccagcttcactccgtccttggcaacaaatggtcagctatcgcaaagcacctccctgggcggactgataacgagatcaagaatttctggaacacgcacctgaagaagaagctgatccagatgggcttcgacccgatgacgcaccggccgagaaccgacttctttgctgctctgcctcaactcattgctcttgcgaacctccgccagcttgtggagcagcggccgtgggatgaccacgctgctaggatacaggttgaggcggtccaggctgcgaagctccagtgcctccagaacctgctccagtctgcagcatccatcaccaccactcccagctccagcagcatgaacaccatccccagtgaccttggcctcctgagtcctccacagatgtcttccttgtctacgttgccttctccaagtttcctggagagtatcagtggccaagacatggtagctggtcaactgtctgacatccagatccctagctctttctttgaacagcccaccagcaacgaggccaaccagcagtcagacttcactccaaagagtagcgtcgagggggagaatggaacccctaaaacgcttctgtcagaaaattcccttccgccgctggccgacttccccatttccaacctgggtgatgcttgcggtgcctcaagctgtgacggtagcagcattcagttcccaagttggcccgagttgtttgatgaacagttcatgtgcgagtttgtatgaattctggcctggagtgagtgtgtttgtgttactctatagtttgtttttttttcagttatagttttcttcccttcttacatctgttttttgtgccatattctggtgtgggtctcagttcagaggtgtagtttccgcatgctgttttttttcctttttgagtgaaaatgtgtgctcctatgcatacactatataccaaacacttgtaaatatacgacactataaattttgaaggtttggatccc

SEQ ID NO: 7690 - DNA, 1254 bp, Zea mays
ctcgttcgttcgcgaaggcgccccttcctgccctcacatccgctcctccctccccgacaccgaccgacccctcgtccgctcgcctccctccccgatccccaccgccatggccgccgccgccgccgccgcgtcctcctcttcctcctccgaggttccgatcgccgcccgcacctgcgtctccgtcggcgaggtggcggtgggcgcggtggctacaggcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgcccacagtgcaagcatccattcgaattcctcagcgtgcaccgctctctcgacggctgcctacatgactacctgtttgaggagagtgtttgcctccttctgagggcagcttggtttgaacctctgatcgtagaggctcacgaggaggctctggaagaagaagagtttctccaccagcagtaccaatacgatgatgacgaagatgatcttgacgaggaatcttattacatgaacaggtccccaagcatccgtattggtaacaggagatggggtgacaatgggtacatcaggggaggcaggaaagaggcgaggccagtgaatactgatgtggctgctggtccatccaggactccgaagaagaaagagaaagccgcatcctcttcggcgtcggtgtcagtgtctggttcggggtcaggatcggggtctgtatccaaggatgtcgctggaaggcgggcgaagagggcgcagaagcgagaagctgcagacaaggcagctgcagagaagcacctgaagcacctgcagaggttggggctgagaaaatcgccagagcctgtagtgcccgaggaggttgggccacaggtgaatgagtgacttaagccgccgcctagtgctatatggtgctgctaaaaacactgcagccctttgggccacaaaataatcttccactgtgaagagcttgagcgtggccttgtatcatggcagcttttcgcctcgttgtacatagtctagtttctcatcactgttttagattcagcacagaaatgcagctgctgtctgcacgactgttgcagctatgaagctgtatgtacctcactgttggtgcactattttagttattgctaatcacaggggatgcaatcggcatctgtgttgattactatggggac

SEQ ID NO: 7691 - DNA, 1593 bp, Zea mays
gcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctagctagccaccttcttcctcctcctccttgtaggtagtagtagtagtaggctacacaacaacgaccacatatatatatacatactaggtactactagcaggcgagcgagattcgtgcagtaattaaggccgcagccagttaataataattagtcgtcggcgagcgagagagatggtggaggaaggcgccaccgcggcggcgtcgaggagcgggccggcgccgttcctgagcaagacgcaccagatggtggaggagccgggcacggacgaggtgatctcgtgggcggagcaggccgctccttcgtggtgtggaagcccgtggagctggcgcgcgacctcctcccgctccacttcaagcactgcaacttctcatccttcgtccgccagctcaacacctacggtttccggaaggtggtgccggaccggtgggagttcgcgaacgagaatttccggcgaggcgagcaaggcctcctgtccggcatccgtcgccgcaagtcaacgacgccgcagccatccaagtacggcggcggcagcgtcgtgaacaccgcgttccctccgccgttgccctttccgcctcccgcgtcggtcaccacgtctggcggtggcggtggtgctggcgctggcaacgagcgcagctcctcgtcggcatcgtcgccgccacggaccgacgacctgaccagcgagaacgagcagctcaagaaggacaaccgcacgctgtccaccgagctggcgcaggcgcgtcggcactgcgaggagctcctgggcttcctctcgcgcttcctcgacgtccggcagctcgaccttgggctgctcatgcaggaagacgtgcgagcgggtgccggtgacgacgccgcgccgcgccgcgcaatggtcagccagctggagcgcggcggcgaggaggggaagagcgtgaagctgttcggcgtactcctcaaggacgccgcaaggaagagggccaggtgcgaggaggcggcggccagcgagcggcccattaagatgatcagaatcggcgagccgtggatcggcgtcccgtcgtcgggcccggggcggtgcggcggcgggaattaagtaaggtatggttggaactgatgcgccacggccggccgtgtgacagctttattacagcgagcgcatgttcgagtcgtggatgctttttgtgcgtgtttgtatttgtcatccaaggtgaggttgatggcaaggataattccagtgctgtggtaaaactgtgaaggcagaacacagggcacaggagataaccgtaacgcatgttaaaagttaattatgggatgctttggaggtagcaagattgaaagtagggaactagggatgaccggatgagtagacggtctagaaagacaagcccatatgtttggaatggaatattatcgtttttat

SEQ ID NO: 7692 - DNA, 800 bp, Zea mays
cgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 7693 - DNA, 1089 bp, Zea mays
gcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaagcccatcccgacgcacgccgtcgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcgccacaccatcgtctccgctctggatgaatggattcaaacccgtcgtcgtttgcttttgctcctcgcgccacgttcaattaatgcttgtgtatgcatgtatgtgccagtatgatgtgccgttgccctggtccattcatttccctttcttttttcggggtgaaatagatgtaaagatctcgtcttgcctgccgtactcgcgctgtgttgggaaaaattggttttcgttccaagtttgtttacgcc

SEQ ID NO: 7694 - DNA, 932 bp, Zea mays; identical to SEQ ID NO: 7616

SEQ ID NO: 7695 - DNA, 1093 bp, Zea mays; identical to SEQ ID NO: 2836

SEQ ID NO: 7696 - DNA, 927 bp, Zea mays
gcccacaatggcgtcccttttcaaggacccgagcaagctctcagcgtacagggaccgccgattcaagggcacacaggaggagtatgaggcaacgctgcatgcgtcgacaacgctgtacattgggaatatgtccttctacaccacggaggagcaggcctacgagctcttctcccgcgctggcgagatcaagaagatcatcatggggctcgacaagaactctaagaccccatgcggtttctgcttcgtactgtactactccagggaggatgctgaagatgctgtcaaatacatcagtggaacgatgcttgacgatcgtccaatccgtgttgatttcgattggggctttgaagaaggcaggcaatggggccgtggacgaagtggtggacaagtgagagatgagtaccgtacagattatgatcctggtagaggtggttacggtaagatggttcagagggaactagaagcacaaagagaactagttgactatggtggatctttccaaccaaatgcaccacctccctatgagagaggtgagcggaagagaggatacggggactctcataggaatgccagaggagattaccagcggaaacgctaccggagcagcgatgaccggtcagcaccagaggagtccaagagagcgcctgactctgatccagcggataagaatcctagatttcgcgagaaaggtgactctgatgaagaagatgatgactacgacaagagacgtcgtcgctaaagctgtgtggaacagtcgttgctacatgcagctgttctggtgtccagtcgctgcagaagagtccacagcgagcagcagtatccggatttcgccctgctgtgcctgtactgttcctccttttcgggctagtttggagccacaaaagtagagcagattggagggcccaaaatacacttattcaaaatttg

SEQ ID NO: 7697 - DNA, 863 bp, Zea mays
agcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgcagccgcagccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagaggtttagtcccatttgcattataaccaattcaatccttgtggatgatttgtgtgattccatcgtgaatctcatggt

SEQ ID NO: 7698 - DNA, 822 bp, Zea mays
ggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgcgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7699 - DNA, 1061 bp, Zea mays
ccgcagttcccccgcgcccgagacgcaaccccgcgccaggagtaagtttgttcttttatcgatattatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaaggtgaggctggtgacggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcattaagtccgtgtggactggtattattcactggatttgag

SEQ ID NO: 7700 - DNA, 2053 bp, Zea mays
tgttgccaaagaattccctcccctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 7701 - DNA, 1142 bp, Zea mays
gaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactgtacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagcccttttaaactgttgtcacttgcattttaccttttccatcgctgtttattgtgagtggtcctatatc

SEQ ID NO: 7702 - DNA, 1233 bp, Zea mays
agcttcgatccggactagctgcccctgccttaaatacaagtatgttgcttagttggatcatcttgatacaagtactgtgtgttgaagggcgggcctggtgcagcggtagagcctaccgtttgtaactggaaggtcccgggttcgagccccagcctctgcatattatgcgggtaaggcttggcgtttaaagatacccttccccagataccgcacagtgcgggaagcctacggcactgggtacgcccttagttagcacaagggtatttttattattgaagtccttacaaggtcatgtcgttctagtgtttctatttctttgctaccagtaggaccctctcctgatatacagcgtatcttggcaggcatagcatacaattggccaattcttcttggtggacaagctcactggacagttggacttgtagcaaccttgatggctattagtagcatcattgctgctgatacatctgctttcctttgtggaagggcatttggtcgtacccctttgactaacataagccctaagaagaccttggagggtgctttagctggcctagctggctgcgtactgaccactgtgctgctgtcgactgccttacgctggccaaggtcgcttttgagtgccacagcttatggaatcctgatcttcctgggttcgttattcggggatcttgttgaatctctgatcaagcgcgacgctggtgtgaaggactccggatcgctcattcctggtcatggtgggattcttgaccgagttgacagctacgttttcacgggggcactttgctactcttttgtcagagtggctctacccctgtacggggtctgattagagcaccggccttcttgttgttttgcctttctccttccatcagcaatgcggtcagtcaccatacattttaacatgcaacgatgagtatttgctgggatgccctagatcagttcttcatctcaagacaacgtggtcttccctccaagcgaatttggtggccactagctcgtcatcgacattgcttcttgctttgggtttgagatggcctttccagctcaaccagtttcttgcaagccttgtaactctgtgtgtacatagtttattttttcatatagagagagagtaaaaaggaaaggctaattattcatcacaaaagctgttaacagtgcattgaggcagcttatgtcaatatgtaccaaactacacttgttttaataattcaaggcactaaattccctatc

SEQ ID NO: 7703 - DNA, 1756 bp, Zea mays
atgcagtccattgaaaacaaaagcgataggaggctctgtctcaccatttgcgttggttataagaggcggttgccatttcgatgacaaagttagaaatgcacagaatgctggattcaaggctgctgtagtatatgatactgaagacaacggtgtccttgtttcaatggctggaagctcgtctggagtccacatatatgcagtgtttgtctctaaagcgtcaggggaggagctgaagaaatattcaggccaaactgacgcagagttgtggataataccaacatacgagaactcggcttggtcaatcatggcaatttcatttatatcactgcttgttatgtctgctatcctagccgcgtgtttctttgcgaggagacaccagataagacgggacagggctcgacttccccaaactcgggagttccatggaatgaacagccggttagttaaagcaatgccaagtcttattttcacgaaagtgcaagaagacgactgcacatcagcaacatgcgccatttgcttggaagactacagtgctggagaaaagctaagggttctaccttgtcgacacaagttccacgcagcctgtgtggacctatggctcacctcctggagaacattctgccctgtatgcaagcgggacgcgaatgctggaacaccagagccccctgtatcagagtcgacgcctttgctctcatcatccgccattcgcttaccagaaccaaccgcttctgtttccttccggtctacagtggcagaagcagcagcagcgtctccccccaggccaatcagccggcatccgtcgccatcacggtccatatcccgcaagcactccgtttcaggttccagcatccctggcacccctatccccaggttccatgcaagctcatcatctcctacctgcacaagtggaagcagtttggacctcgcaaacatgtcgtcgtctccatggcctcgcgcttcgcaccttgcatctgctcactattcgtgcagtggccgcctgtccccgccgatccacatcaggaatacctctgcagcacacgtctcgcgctctgcctatggatctcccagtcgttacgtaagctcgtcacacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaacattgatggtggctccagtaaagctcccggccgtgaggaatcatacatggcaccgaattgacatgtggatttgagctcctcagcatatatagttcaccatgatgatgagaaaaaaaaaaggtgcgacagaactgcctgtaagaagagagaatcgcatcccccagaatgtgtggcttcatcttgaagaagcaaatgcccatgtcgggtttcacaagcgtttagcgtgtactgatacagctctgtagtaattctagttgctgtttgtctatcgaggtttgagccggtagcattccttcctctctcttttttgttcctattttttaattagttatataacagacaaggttttcaagaaaagaaataacaagttttacccctgc

SEQ ID NO: 7704 - DNA, 1004 bp, Zea mays
acaccgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccatcctgaccgggacctggcggcccagatgccaatcaccttccgcgtgcagcccagccatcccaacttgcaggagaacaattagactgctggatgccctcgttccactcgccgaggatttcacccagccaccaccgctggcttgtatgccctcgtgcgctggcaactgtatctttatctttccggtatgtttggatgaacgtataatgtgtgtcagtgtcggtcgcatgacgtgccgatgtcgtgcatctctctctctctctgccagagcagcggaactctgcaccgtgagtaacttaattggtaccgtatgatctgccggacagtgaatagtttatgtgagtgggtc

SEQ ID NO: 7705 - DNA, 825 bp, Zea mays
ttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 7706 - DNA, 1129 bp, Zea mays
atagaaatcaggtggcataaatactgtgcagggctaaaggttggtgggtcgaatggaccaggccatcaggttatcgagaaagctctcatctctactatttctaggctagcctaggtctggaccagttaggcacgcaagtatcaatcgattcataagaggaggaggccattgagggagccaagtagaaggcagtcactgcaaacaacgaaagctggtgagcaactttgtcaagcctcaagagctcatggaagatggcagtgctccaagacggtctactccacccacccgcagaagcagatctgctgagttccacaatttttcagaaaggaggagaagggataagatcaacgagaagctgaaagcattacaggagcttcttccaaactgcaacaagaccgacaaagtttcgatgctagacgaagcaatcgactacctaaaatcccttcagctccagcttcagatgctggtcatggggaagggaatgtcaccagtggttcctcttgagctgcagcaatacatgcattacatcacggctgaccctgcccagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctccttgcctccttatgacaaaatttgacacggcaggcgtgcagccttgaactgggaagagatcgttcagtttgggacctgcagcatggttcacctgagagaattccgtgaatgtgtagtactagttaactagctagctagttgtgttattaaataaaacgttgtgattgtgatgctgctcattttactatctgaatcttacggtccaattctcctccatgttcatgcaaaggctgacaggtggcgtctgtatttatctgtgcagcagtatgctactatttgttagattgatctcatctagttcggttaaagggccgaacctt

SEQ ID NO: 7707 - DNA, 838 bp, Zea mays
gaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 7708 - DNA, 1299 bp, Zea mays
gtcgctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttgtatcctttgattccttcatcatttgttttctttgttctttaatcatctggtttctgcttattactatggtacttgagctccagtggcataatattgtacctcttaactagacctccttagaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 7709 - DNA, 1366 bp, Zea mays
ccgacggccgtgggggcatcgacggccgggcgacgcgacgcgatgtgaccatgacccgtcagtcagcagtacaaaatggcgatgatggtggatcctccgaatggaatcgggaaccaaggaaagcattactactctatgtggcagaccttatttgagatagacaccaaatatgtgccgatcaagcccattggtcgaggagcttatgggatagtttgttcatccattaatcgtgaaacaaatgagaaagtagcaataaagaagatacacaacgttttcgacaaccgtgtggatgcactacggaccttgcgggagctgaaactccttcgccatctccggcatgagaatgtcattgctttgaaggatataatgatgccaatacacaggagaagctttaaggatgtgtacttggtatacgaactcatggatactgatttgcaccagataatcaaatcacctcagggcctttccaatgaccactgccagtattttctttttcagttgctccgaggactcaaatatctccattcagcagaaatactccacagagacctaaaacctggaaacctgctggtgaatgcaaattgtgatctgaagatatgtgattttggtctcgcacgtacaaacagtagcaaaggccagttcatgactgaatacgtcgtcacccgctggtacagagctcctgagctgctcctctgctgcgacaactacggcacatccatagacgtctggtctgttgggtgcatctttgctgagctccttggccgcaagccaatatttccaggaactgaatgcctgaatcaactcaagctcatagtgaacgtcctcggcaccatgagtgaggctgacctagagttcatcgacaacccaaaggctcggagatacatcaagtcccttccctatacccctggtgttcctctcgtaagtatgtacccacatgcgcaccctcttgccattgatctgttgcagaagatgctcatcttcgaccccaccaaaaggatcagtgtcaccgaagctctcgagcacccttacatgtcccctctgtatgatccaagcgcaaatcccccagcccaagtgcccatcgatctggatatagacgaaaacatcagctcagagatgatccgggaaatgatgtggcaggagatgcttcactaccaccctgaagttgccacagcaataagcatgtcatgagagattccacagcccccaggacatcagcgggggctcacctcttctttttttgtctttgataaaagcctactgcgagtagccgattattgcggcacctagctgttatagtacacttaatgtctgcttggaaccaattatggcgcctagctgttgtagtacccttaatgtctgcttggac

SEQ ID NO: 7710 - DNA, 808 bp, Zea mays
caaacaacgtatcttgttgttagaaagctggtgagcaactttgtcaagcctcaagagctcatggaagatggcagtgctccaagacggtctactccacccacccgcagaagcagatctgctgagttccacaatttttcagaaaggaggagaagggataagatcaacgagaagctgaaagcattacaggagcttcttccaaactgcaacaagaccgacaaagtttcgatgctagacgaagcaatcgactacctaaaatcccttcagctccagcttcagatgctggtcatggggaagggaatgtcaccagtggttcctcttgagctgcagcaatacatgcattacatcacggctgaccctgcccagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctccttgcctccttatgacaaaatttgacacggcaggcgtgcagccttgaactgggaagagatcgttcagtttgggacctgcagcatggttcacctgagagaattccgtgaatgtgtagtactagttaactagctagctagttgtgttattaaataaaacgttgtgattgtgatgctgctcatttt

SEQ ID NO: 7711 - DNA, 1888 bp, Zea mays
caagccgtatcgtcttctccctcttgtccggttcgggtggtccgcggtcggggtgagtgagtgagcagctttgcttctccatctccccgttcccttccctccccagccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcgtcatggggagcccctgcagcgttcaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgatttcgtcatctctcttgatgaccgttatctctactttgtaaattggcttcatggcgatattaggcagtacaacattgaggatcccgcaaagcctttcttggctggacaagtatgggttggtggtcttcttcagaagggcagtgatgtcgtctatgttactgatgatggtcaggaacagcagtacaatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaacaggctgctggagaatccctgttgttgtatgcactgtaattaacatggtatccgtgcggtgttctgtcttgtactgcgactgttgccagtggaataaggcatggtttcatgagaactctagattaataaaagaagtcctgattct

SEQ ID NO: 7712 - DNA, 608 bp, Zea mays
gccgacaaaaccagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgttgactacatcatctctggccctgtggtggccatggtctgggagggcaagagcgtcgtcacaactggccgcaagatcattggcgccactaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaaaaatgtcaccatttgtgctttagcaatgttttcgaaaagattatgatctgtatcttggaacctt

SEQ ID NO: 7713 - DNA, 1298 bp, Zea mays
gaagcgagcgagcgagcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccacggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggtacagtgacctgctaaatgtgcttgacgttgcattgacatttgtatgagctgagtcgctcattcctttttatgaacgcctgtactcttctcattctctccctgcatttttgtcattcagctggatatttcgaatctggtgtgttttgagatgtattaaagaacgtcaaatagatt

SEQ ID NO: 7714 - DNA, 1070 bp, Zea mays
cgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatgg

SEQ ID NO: 7715 - DNA, 773 bp, Zea mays
caggcgcacggctcacgttgtccgcctcacgtaaaggtcggtgccatcctctcctatctctcctcgcgcagttccacttcccattttccgccttcgtccgcatcagggacacactgcctccgatccgcatgcggcaagatcctccctcattctccaaacatgagaggagcagaggaggagagatctggcaccgccactgatgcgggaggagaggaggagaaacaggagaggagcgtcggcctgatggccggcctcatggacaaggccaagggcttcgtggtggagaaggtgatgcaaatccccaagcccgaggctgccctggatcacgtctccttccggagcatcagccgcgagggcgtcgagctgcatagccacgtcgacatcagcaacccctactctcaccgcatccccatctgcgagatcacctacacgttcaagagcgccggcaaggtgatagcgtcgggcacgatgcccgaccccgggtggatcgcggcgagcggcagcaccaagctagacctgccggtgaaggtgccgtacgacttcatcgtgtcgctgatgaaggatctcggaggggactgggacatcgactacatgatggaggtggggctcactgtcgacctccccgccattggcgcctttactatcccgctcaccaccgagggcgagatcaagctccccaccttccgggacctattgttctaagcaattcagatatttggtgtatgaatcgatttgttttcacaccataatcaatgctgatgtggatttgcaat

SEQ ID NO: 7716 - DNA, 1404 bp, Glycine max
gtgagactcacggtcatgactcatgtaaattcgtctcccacaacaacactagctctcacgtacataaatataaagatgttgatagcatattataaatcatagagttcattccatacacagaaagaagaacaacactaagaaagcagaatagggaaaaatacatcgatagaggaaaattaattgaagggtgctactactacgaccttctatatcattaatgattgaaattcgtgttggaattgtcttgtaggtgtagtagtgataataagagaggatcatatatatattagtagtgctagaaattaattgaagtgtgtaatagaatagagtgtgatagagagagatatggggagaggaagggtgcagttgaagaggatcgagaacaagatcaataggcaagtgacgttttcaaagagaaggtctggtttgctcaagaaagcacatgagatctctgtgctttgtgatgctgaagtggccctcatagtcttctccaccaaaggcaaactctttgagtactccagcgatccatgtatggaaagaattcttgaacggtatgagaggtattcatatgcagagaggcagcttgttgcaagtgatcaaccacaaactgaaaattggactctagaacatgcaaagctcaaagcaaggttggaagtcctacagaaaaatcaaaggaattttatgggacaagatttggagggcctaagtatcaaagagcttcaaaatttggaacatcaacttgatagtgctctaaaacacattagatcacggaagaaccaaatcatgcatgaatctatttcagagcttcataaaaaggataaggtcctacaggaacaaaataacactctcgcaaagaagataaaggagaaagagaaggcactagcccagcatgcacaaatggagcagcgtggtgatgaaatggatcttacttcctctgccctagtacctcatccattggagacatcaaacattagagagtcctcacaaataaggggtgaaggagataatgaaggaaccccaactccaacccgagcaaatgccattcttccatcttggatgcttcgtccttcaaatgaatagaagagtattaacgacctaaaattttaaattacatatgaatatggcgaatacaaagcttaccctataagatgtaaaatggtctatgtgttgaattgtgaacaccacccaatgagttcaattggaatatcatagatatgtaatgtgtctctgactactacatttcaaggatgctaagtaaattatatggtatggcctgtctagatatagacctgcaatacatatatagtgtcaattatgtatgcttggttcttatcaaaagtttaagttggactttacatgcctctcttcctagaaattcggaaggtaaacataatttcagtacac

SEQ ID NO: 7717 - DNA, 638 bp, Glycine max
caaaataagtgatcttggaaagacaattggcctcttcaacacaaaagtctgcatgtgaagaagaggccaattgtctttcaagatcacttattttggctattgtaatcatgaacttcttctttgtgggtatggcattggcaaaggatatacctgatgttgaaggagataaaatatatggcattgatacttttgcaatacgtataggtcaaaaacaagtattttggatttgtattttcctttttgaaatggctttcggagtttccctagtggcaggagcaacatcttctagccttttggtcaaaatcatcacgggtgtggggaatgctgttcttgcttcagttctctggttccaagccaattctatagatttgagcagcaaaacttctggtggatccttttatatgttgatctggaagctaatgtacgcatcatacttcctcgtggctttaattagataaaaatgtaacagaaggttaaagcagtgaaacaacaaaaactatagcgatatatgttttcccggatattatttcttgtatcattaatatttttctttaattgtgtaaagacttcttgtgtatttacacagagacttcgatctattgttaaatatttcataaatggaacagcttgttatgctg

SEQ ID NO: 7718 - DNA, 1989 bp, Glycine max
caatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtcc

SEQ ID NO: 7719 - DNA, 1205 bp, Glycine max
gtcagagtgagaaagagagagagagagagagaaactgagagaaattcgcaaaccctaatttcggaaagatcggcgatggctgcctccaaggatcgcgagaacttcgtctacatcgccaagctcgccgaacaggccgagcgatacgaagagatggtggaatcaatgaagaacgttgcgaatctcgacgttgaactgactgtggaggagcggaatttactttctgttgggtacaagaatgtgattggtgctcggagagcatcgtggaggatcctgtcttccattgagcaaaaggaagaaacaaaagggaacgagttgaatgcgaagcggattaaggagtacaggcagaaggttgaattggagctttcaaacatctgtaatgatgttatgacagtgattgatgagcaccttatcccttcggctgcagctggtgaatccactgtgttttactataagatgaaaggagattattatcgttatcttgccgaatttaaggcaggcaatgagaagaaggaagctgctgatcagtctatgaaagcatatgagtctgctaccactgcagcagaggctgatttacctccaacacatcccatccgattgggtctagctttaaatttctcagttttctattacgagatcttgaactctccagaaagagcctgtcatcttgcaaaacaagcttttgatgaagctatttctgagcttgacaccttgaatgaggagtcatacaaagacagcaccttaatcatgcaacttctcagggacaacctaactttgtggacttctgacatcccagaagatggagaagatgcccagaaagtgaatggcactgccaagcttggtggaggtgaggaggcagagtgagtccgattgttgatgggatcttccttaggattcgatgcatgcgtttgggaatgaaacatgagggccgttacttatccgtgtattagctagagatagggttccattgttttctctttgtttcttgttgattgccccatacttcccgataggggaaagagatactccatttgtgctatatttatggtatgtttttatttgtgtggtgtctggaaatggcctatttcattcccaatccttttcctccagtctctgggggatttgattgatgagaattgcttatggtgtatttccttttccaatgaaatgctacaacctttactgcaatgttggagatttattcttcg

SEQ ID NO: 7720 - DNA, 1684 bp, Glycine max
gcagggttctgttctgctttgcattctccgccatcatcatgcaagcgcttcactctcccaccctccgcgcttctcccttggaccctcttcgtggccccaacaatgccgccgccaaccgccgctcctccagcgccaagcgcgtgttcttcgtctccgccacggtggcgccgaaggtgtccgccccgcagcgacagaaggaccccaagaagcgcgttgtgatcaccggaatgggcctcgcgtcggtgttcggtaacgacgtggagggttactacgagaagctcctcgccggcgagagcggcatcaccgccatcgaccgcttcgacgcctccaagttccccacgcgtttcggcggccagatccgcggcttctctgccgagggctacatcgacggcaagaacgaccgccgcctcgacgactgcctccgctactgcattgtcgccggcaaaaaggccctcgaaaacgccgaccttgcccccgacaaccactccaagattgataaggagcgtgctggtgttcttgtaggctctggaatgggaggcttaacggtgttttctgacggtgttcaggctctgattgagaaggggcacaggaagataacgccgtttttcattccttatgcaattactaacatgggttcggctttgcttgggatagaccttggattcatgggtcccaactactctatatccacggcttgtgctacttccaattattgcttttatgctgcggcgaaccatattcggagaggggaggctgatttgatgatagccggtgggactgaggctgccattattcctattgggttagggggttttgttgcttgcagagcgctttctcagaggaacgacgaccctaaaaccgcttccaggccatgggataaggaacgtgatggctttgttatgggtgaaggtgctggagttttggtaatggagagcttggagcatgctatgaagcgaggcgcacctattattgctgaatatttgggaggagctgttaactgtgatgcttatcacatgactgatccaaggtctgatggacttggtgtgtctacatgcattcagagcagccttgaagatgccggtgtgtcaccagaggaggtcaactacataaatgcacatgcaacttccactcttgctggagacttggcagaaattaatgctattaaaaaggttttcaaggacacttctggcatcaaaattaatgccaccaagtctatgatagggcactgccttggtgcagctgggggtttagaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtggcattttctgctttcaagccttgattgcccagcttagcttgtctgcactttatgtagaacacgggtttaagttaattgaaattttgttccctctacatcattgaggttatttactctagctgagtccatcatcatatataaaaagctgtaggcatgtagttgttcattttgtgcctaattgtgacttgacaattagctataagactattttgtagtagaacattttgaatatagctcgaagattttattagtttggaggt

SEQ ID NO: 7721 - DNA, 1151 bp, Glycine max
ggaggaagagagaaaaaccatggcaataacactcaacaatggcttcaagatgcctatcattggattgggcgtgtggcgcatggaaggaaacgaaatcagggacctaattctcaattccatcaaaattggttatcgccattttgattgtgctgctgactacaaaaacgaagcagaagttggagatgcgcttaaggaggcttttgatagtggccttgtgaagagagaggatctcttcattaccaccaagctttggaattctgatcaaggccacgttcttgaggcgtgtaaagacagtctcaagaagcttcagttaacgtatctagatttatatcttgttcactttcctgttgccgtaaggcatactggggttggtaatacttctagtcctttgggtgatgatggggtcctggacatagataccaccatatccctggaaacgacctggcatgcaatggaagatcttgtttcatcgggcttggttcgcagcatagggatcagcaactatgatatctttctgaccagagattgtttagcatattccaagataaagcctgctgtaaatcagattgaaactcatccatacttccagcgtgattctctagtcaaattttgtcagaagcatgggatttgtgtcactgcacacactccactaggaggtgctgcagcaaatgctgaatggtttggaacagtttcatgtttggatgaccaagttctcaaaggtctggctgaaaaatacaaaaagactgccgcccagatcagccttcgctggggaattcaaaggaacactgtggtcattcctaaatcgtcaaaactggagaggttgaaagagaactttcaggttttcgattttgagttgtctaaagaggacatggagctcattggaagtatagatagaaaatatcgaaccaatcaaccagctgtgttttggggcatagatttgtatgcgtgagaatgcccttcctaagtctgtatcatggctgtttgaccttgtgttaagattcagatttggtataagctgatctttcaggctccttagtagctcagtttatttgataatgtaaactttctttgttgatggttgaaaaatcatcttctcatcccatatccaatctcgtggactaaataagagagacttctgaatgttgttgctt

SEQ ID NO: 7722 - DNA, 1736 bp, Glycine max
caaaaaatggcatcggataaggtggtggaaacggtcatagcagggaactacgtggaaatggaaactgaagggaagcccaaggacgtaaaaaccaagctatcaagcttgttgtggcatggaggttctgtttatgatgcttggtttagctgtgcttctaaccaggtggcccaagtgctgcttacgttgccatactcattctcccaactgggaatgctttctggcatacttttccaaatcttctatggtttactcggaagttggacagcttacctcattagcattctctacgttgaatacagaacaagaaaagagagagaaaaagttaacttcagaaaccatgtcatccagtggtttgaagttcttgatggactcctcgggaagcactggagaaacgtgggtttggcctttaactgcacatttcttctgtttggatctgttatacaattgatagcttgtgcaagcaacatatattacataaatgacaacctggacaagaggacttggacttacatcttcggagcttgctgtgccaccactgtctttattccttcctttcacaactacagaatctggtcctttttgggcctccttatgaccacttacactgcttggtatctcacagttgcctctctccttcacggtcagatggaaggagttaagcattcgggtccgaccaaattggttctatattttacgggggccacaaacattctctacacattcgggggacatgctgttactgtggagataatgcacgcgatgtggaagcctcaaaagttcaaggccttatacttactggcaaccctgtatgtgctgacactgacgcttccatcggcagcagcagtgtattgggcatttggagacatgcttctaaatcactccaatgcttttgctctccttccaaaatcacccttccgtgacatggctgtcattttaatgctcatccaccagtttataacattcgggtttgcatgcaccccattatacttcgtgtgggagaaagcaatagggatgcacgagtgcaagagcctatgcaagcgtgcattggtgagattaccagttgtgatccccatatggttcttggccatcatattccccttctttggtcccatcaactccaccgttggctctctccttgtcagcttcaccgtttacatcatccccgccctcgcccacatcttcaccttcagatcaccctcttccagacagaatgcagtggaacaacctcccaaatttgttggaagatgggtgggaacctttattatcaacacttttgtggtggtgtgggtcctagtcgtaggatttggatttggagggtgggccagcatggtgaacttcatacgccagattgacacatttggactcttcacaaagtgttaccaatgccctccaccgcttctaccacctatgccgccgcatcagctcaacgccaccgcgccttccccacttcaccaccctcatcatgcacactaaggattgcactctttaaagttcaaattgagacccatctatgaagcggcaccctaggctctttggtgaaattattaacggtgcaatacatgtcattgttacgttgagaatgataaatttgtaatgtattggccgtgtcataattaaacatataatgtattcttcaattatccttctctttatagccttaaggtagttttgagcactttgtcatggtcagttatcataagaagaaaaaagaaaataaaacgataaggtttatgatg

SEQ ID NO: 7723 - DNA, 1387 bp, Glycine max
aagcaaagcacaaccacacttgaacctcataagcggagccacccctccctgcccccaaggaataactcttccgacagcaaccctgttcgtttataaccatcaaccaccttaaaccctgggtagctagctttttttttcattattgtgtcggcaatcggttgaggaaaaaaaaaacacagaggagggtgcaaaaagcagggtggtggatgatggaaggggtttcgagggaggctcagatgtcgattgctgcttcgtccatgtttcctggattcagattctgccctaccgatgaggagttgatttcttattacctgaggaagaagttggagggtcatgaggagagtgttcaagtcatttctgaggttgagctttgtaaatacgagccttgggatttaccagccaaatcattcattcagtcagacaacgaatggttcttcttctctccccgcggaagaaagtacccaaatggttcacaaagtaaaagagcaactgaatgtggatactggaaggcaactggcaaagagcgtaatgtaaagtcaggttccaacattataggaacgaagcggactttggtgttccacttagggcgtgcacctaaaggggaaaggactgaatggattatgcacgagtactgcattaatgacaaatctcaggaatctttggtcatttgtcgcctcaagaggaacacagagttccgtttgagcgatgcttcgaatagagcttcatcaagtcaaaggcatccggtgaattcacatgaaagtggttgtgctatctcaggaggtggtattgatcaaagggatgcttgtgagcaagacaaagaggttggatgtagctccaagagggacagtagcagttatggttctccttcaatggagcaaattgattctgtgtccgaatcgaatcagcgaccagttaacgaagctactttcactgaatcttcaggtcaaccaaaggaggggtatgaagaggattgttatgcagagatactaaaggatgatatcatcaaattagatgaatcatcagtcttggtagagagtcacacaagaccacaggatcctacacagatgcaacctgcaccacaaggcacagcacaacggagaataagattaagggttgggaattcaaagcattctcgtgcagtagttcgtttcccaagcacaatgcactcatcaaagaataccttctttgccagaacaaccaacagtttggtggtattagctttcttcgttttcactttgatggttctatattttttgtccttagtgagaggacaaaaacaagacaagtattgtggggaattttcgggtgtaaatcatgattagtgctacacaaagcgtaggcaatttgttaaactgcttctttcctattaatatgttgcattagcctt

SEQ ID NO: 7724 - DNA, 1160 bp, Glycine max
gagagagcaagtgacaagagtggagtgagagatagtgactgcaaaaccgctccagccttgtttcttctcagatcttcttccatggaacagtacgagaaggtggagaagataggcgagggaacatacggcgtcgtttacaaggctcgcgaccgcgtcaccaatgagaccatcgctctcaagaagattcgcctcgagcgggaggacgaaggcgttcccagcaccgccattcgcgagatttctctcctcaaagagatgcagcataggaacattgttaggttgcaggatgtagtacacagtgagaagcgattgtatctggtttttgagtatctggacttggatctaaagaaacatatggattcatctccagagtttgtgaaagatccacggcaagtaaagatgttcctttatcaaattctctgtggcattgcttactgtcattcacatagagttcttcatcgagacttgaaaccacagaatttgttgatagatcgccgtactaattcactaaagcttgcagattttggattggctagggcatttggcattcctgtcaggacatttacacatgaggtggtgacattatggtacagagctccagaaatattgcttggatctcgtcattattctacgccagttgatgtttggtcagtgggatgtatatttgcagagatggtaaaccgacgacctctattccctggggactctgagattgatgaattatttaaaatattcagaatcttgggtaccccaaatgaagacacatggcctggtgtaacttcattgcctgattttaaatcaacatttcccaaatggccatccaaggacttggcaaatgtggttccaaatcttgatgcagctggtcttaatcttctttctagtatgctttgcttggatcccagcaaaagaatcaccgccaggagcgctgtggagcatgaatacttcaaagacattaaatttgttccctgattccatatcttgatggcaaacgtgtttatagtaatattgtgcagaatttatgggttttgactctgcgagaaatgcgtgctgtctttttctattttcttagtgacttgggagtgtgagccatatttccattttttggtccttacagaatgtttcagattcaacttgagtgtgattatattgcatattactttttc

SEQ ID NO: 7725 - DNA, 1052 bp, Glycine max
ctctctctttctctttctctctcatccagatcttgcaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccatt

SEQ ID NO: 7726 - DNA, 1263 bp, Glycine max
caatctctcttcttacccatttcctccccccctctttctcttttcttgttctgtttttattttcactgttctctgataacaacgttgttagttgtcaccatggttgttctgtctcagccagcattaaaccagtttttccttctgaaaacatgcaagcccacgcccttgttcgcggggattcctgtggtcgacctcacggaccccgatgccaagacccacatagtcaatgcctgcagggacttcggcttcttcaagctcgtgaaccacggtgttccgttacagttcatggccaatttggaaaacgaaaccctcgggttcttcaaaaaacctcaatccgagaaagacagggctggtccccctgacccttttggctacggcagcaagaggattggccctaacggcgatgtcggttgggtcgaatacctccttctcaacaccaaccctgatgtcatctcccccaagtcacagttcattttcagagaaggtcctcagaatttcagggcggtggtggaggaatacattagagcggtgaagaacatgtgctatgaggtgttggaattgatggctgagggattggggataacgcagaggaatgtgttgagtaggttgctgaaggatgagaagagtgattcttgcttcagacttaaccactacccgccatgcccggaggtgcaagcattgaacggaaggaatttggttggatttggagagcacacagacccacagataatttctgtcttgagatctaacagcacctcaggcctgcaaatctgtctcacagatggcacttgggtttctgtcccacctgatcaaacttcctttttcatcaatgttggtgacactcttcaggtaatgactaatgggaggtttaaaagtgtaaagcatagagttttggctgacccaaccaagtcaaggttgtcaatgatctactttggaggaccacccttgtgtgaaaagatagcacctttaccttcactcatgttaaaaggagaagagagtttctacaaagagttcacatggtgggaatacaagaaggctgcgtacgcgtcaaggctagcggataatagactcggcccttttgagaaatctgctgctgattaaggaggcaaagtgtgtcaaaattctactactcaattttggcacgtgttgttaggccaacttttttattttttattttttttgggtgtgtgtatctaggttccaaacagttgactttacttgagatatatagaaaatgaataggttgcttatgcacttcctttt

SEQ ID NO: 7727 - DNA, 1079 bp, Glycine max
cagccatgttcttaaccagaagcgcgctttttcgcttttcaaagtctctcccttatgccccttcactctcccttaaaccctccatggtcaccttctcctctactcccaattcaggctggagaaatgcagcagaaggaggaagaagagacggaagaaccaattggacgtatgattctgccgaggcaagacgcgaggcagatgaaatgtctgagagtgccaaagaaacgatgaatgaaggctatgacagggccaaggatcaagcgcgggaagccaaagacagaacaaaggatttcgcacacgacgcaaaggagaagacaaatcagcctcaaagtcaccaggtatctacaattctgccactgctgacaacaaaaccggttccaaggtcggagagtacgcagattatggttctcagaaggcgaaagaaacaaaagatgcaacgaaggaaaaagctggagagtacacagattatgcttcgcagaaggcgaaggaaacgaaggacaagacaatggaaaaggctggagagtacactgattatgcttcgcagaaggcgaaggaaacgaaggacaagacaatggagaaggctggagagtacacagattatgcttcgcagaaggcgaaagaagccaaggacaagacaatggagaagggaggggaatataaagactatgctgcagagaaggctaaagaaggaaaagatgctactgtgaataagatgggagagtataaagattatacggcggagaaggctaaagaggggaaagatacgacgttggggaagcttggggagctgaaggactctgcggctgatgcggcgaagagggcagtgggttacttgagcggcaagacagaggaaaccaaagagaaagtctcggagacggcagaggcgacggctaataaggcggcggagatgaaggaggccaccagggagaaggctgccgggactgcggaggcggccaagaacaaggccgcagaggtaaaggacagagctgcagaaaccgcggaggcggccaagaacaagactgccgagactgctgaggcagcgaagcagaaaaccgcacaggcaaaggacaacgccaagg

SEQ ID NO: 7728 - DNA, 1694 bp, Glycine max
gcctcacaaaagcaaagatcaaacaaaccaaggacgagaacacgatgttgcttgaacttgcacttggtttattggttttggctctgtttctgcacttgcgtcccacacccactgcaaaatcaaaagcacttcgccatctcccaaacccaccaagcccaaagcctcgtcttcccttcataggacaccttcatctcttaaaagacaaacttctccactacgcactcatcgacctctccaaaaaacatggtcccttattctctctctactttggctccatgccaaccgttgttgcctccacaccagaattgttcaagctcttcctccaaacgcacgaggcaacttccttcaacacaaggttccaaacctcagccataagacgcctcacctatgatagctcagtggccatggttcccttcggaccttactggaagttcgtgaggaagctcatcatgaacgaccttctcaacgccaccactgtaaacaagttgaggcctttgaggacccaacagatccgcaagttccttagggttatggcccaaggcgcagaggcacagaagccccttgacttgaccgaggagcttctgaaatggaccaacagcaccatctccatgatgatgctcggcgaggctgaggagatcagagacatcgctcgcgaggttcttaagatctttggcgaatacagcctcactgacttcatctggccattgaagcatctcaaggttggaaagtatgagaagaggatcgacgacatcttgaacaagttcgaccctgtcgttgaaagggtcatcaagaagcgccgtgagatcgtgaggaggagaaagaacggagaggttgttgagggtgaggtcagcggggttttccttgacactttgcttgaattcgctgaggatgagaccatggagatcaaaatcaccaaggaccacatcaagggtcttgttgtcgactttttctcggcaggaacagactccacagcggtggcaacagagtgggcattggcagaactcatcaacaatcctaaggtgttggaaaaggctcgtgaggaggtctacagtgttgtgggaaaggacagacttgtggacgaagttgacactcaaaaccttccttacattagagcaatcgtgaaggagacattccgcatgcacccgccactcccagtggtcaaaagaaagtgcacagaagagtgtgagattaatggatatgtgatcccagagggagcattgattctcttcaatgtatggcaagtaggaagagaccccaaatactgggacagaccatcggagttccgtcctgagaggttcctagagacaggggctgaaggggaagcagggcctcttgatcttaggggacaacattttcaacttctcccatttgggtctgggaggagaatgtgccctggagtcaatctggctacttcgggaatggcaacacttcttgcatctcttattcagtgcttcgacttgcaagtgctgggtccacaaggacagatattgaagggtggtgacgccaaagttagcatggaagagagagccggcctcactgttccaagggcacatagtcttgtctgtgttccacttgcaaggatcggcgttgcatctaaactcctttcttaattaagatcatcgtcatcatcatcatatgtaatatttactttttgtgtgttgataatcatcatttcaataaggtctcattcatct

SEQ ID NO: 7729 - DNA, 922 bp, Glycine max
attctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgt

SEQ ID NO: 7730 - DNA, 2043 bp, Glycine max
ccagttcaatatcctagtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7731 - DNA, 1406 bp, Glycine max
cgcgctcgcgcgagatcgacttcgagaacccgccgccgtgggacgagcagcagaaccaaaactacaaggccaagttcatgtgcagctacggcggcgacaccaagatcctcgccgtcgaccgctccgttaagttctccgccttcctctccaagctctccgccctctgcgactccccgccacaggacctcaccttcaagtaccagctccccggcgaagacctcgacgccctcatctccgtcaccaacgacgacgacctcgaacacatgatgcacgaatacgacagactctatcgccctaacctaaaacctgttagaatgagactcttccttttcacactctctaattcaaaccctaattcctctttctcctccgaacgcgaccgtttcgttgaggctcttaattcgggtccggttccttctcaacccgatccgatcaaaaccccacccgttacgccttctaatgttgattatctcttcggtctcgataaagccgttgctcctccaaatcttcctccgaacttcgcagcggttaaattccacgatccggtgccggaacctgtcgctccgacgccggtagagtatcaatcgagagtttccgatcgggttgttggatcggatccgaatgtgaattcgatggaaattcagagacagatgcagcaggagatgcagcgattgcagattgcggagaatgaatatcgtagaaggagtgaggatggatttgcaactggttatgctgctgcagccggaggagattattacatgcagaaggtgcaggagaaggttccgccgcagaatgcggcggtgccgcctccggcggcgtactggtcggagaagcagttttccggggagggatatcagacgacggtgacgacggcggctccgggaggaggtgaccagccgatgtatgttatggcggcgccggggacgttctatcaccactcgccggtgatgcgacctccggcggcggcgcagggatactacgctgtgcagaggatgggttctgatggctaccgtgaacagcaggcggtgtacggaggcatggctgcgccgaaagcggggttttcgacggcggggatggttaaggggccggcgtattcggagggatatagtggcggcgtggtgaggccggcggggttgccggataatgcggcgtatgcgcaggtggcgtatgatagcgcgagtgggagacaggtttactatactgcgcagggaggagtggtgcacgcgccgccgcagtaccaggggggtccgcctcaggatgtgaggccgggtggggtttcggtggggcaggatggtaaggtggttaacaaggttaaccaaggttctgtgtgattataatagctgtgattgagattgtcattatgttaattttgaaataaataatacactaaatatgttttgcttttt

SEQ ID NO: 7732 - DNA, 1988 bp, Glycine max
ctagttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttt

SEQ ID NO: 7733 - DNA, 1845 bp, Glycine max
gagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgc

SEQ ID NO: 7734 - DNA, 1703 bp, Glycine max
cgaggcttagttgagcctataaataaccccacacacttgtccggcctcctaagactcgctacatcttctttccaaatcccaactactactcacactcactgcagatctcaatccatggctaccattgttagcatcaaggcccgccagatctttgacagtcgtggcaatccaaccgtcgaggtggatttgacatgctccgatggtacttttgctagagctgctgttccaagtggtgcatccactgggatttatgaggcccttgaattgagagatggaggatctgactaccttggaaagggtgtatcaaaggctgttgacaatgtgaacaccattattgcccctgctttggttggcaaggacccaactcagcagactgctattgacaacttaatggttcaacaacttgatggaactgttaacgaatggggttggtgcaagcaaaagcttggagcaaatgccatattggcagtgtctcttgcagtctgcaaagctggtgctgctgtcctgaaagttcctctttacaagcatattgcaaatattgcgggtaacaaaaagttggttttgcctgttcctgctttcaatgtcattaatggtggatcacatgctggaaacaaacttgctatgcaggagtttatggttcttcccgtgggagcttcctctttcaaggaagccatgaagatgggtgtagaagtatatcacaatttgaagtctgtgattaagaagaaatatggtcaagatgcagtaaatgttggtgacgaaggtggctttgcccctaacatccaggaaaacaaggaaggtttggaattgctgaaaactgccattgccaaagctggttacacaggcaaagttgtcattggaatggatgttgcagcttctgaattctacaaggaagataaaacatacgatttgaacttcaaggaagataacaatgatggctcacagaagatctctggagatgctttgaaagatctatacaagtcatttgtgacagagtatccaattgtttcaattgaggatccttttgaccaggatgactgggagcactatgctaagcttactgctgaggttggaaccaatgtacaaattgttggtgatgatctcttggttaccaaccccaagagggttcagaaggcaattgatacaaaagcatgcaatgctcttctccttaaggtcaaccaaattggttctgtgactgagagtattgaagctgtcaggatgtccaaaaaagctggatggggtgtcatggcgagtcacagaagtggagagactgaggataccttcattgctgacctttctgttggtttggcaacgggtcaaattaagactggagctccatgcaggtcagagcgtcttgctaaatataaccagctcttgagaattgaggaggagcttggtgcggaagcagtgtatgctggagctaacttccgtacccctgttgagccctactaaagttttcaagtggaaaaaacctggagatccccacgagtttgagcaatgagatttggatgcgcggttttagttgtgatcaataagtcgatagttagaacaatagtcttggtataaggaccttgccaataattttttagttctgattcacagagctaagacagttccgtcttagactttaaaagttttgatatttagctttaatacttgaagtttacttccaattttatggggtatccccaaaacatttcatactc

SEQ ID NO: 7735 - DNA, 1985 bp, Glycine max
tcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttg

SEQ ID NO: 7736 - DNA, 2021 bp, Glycine max
cgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7737 - DNA, 1994 bp, Glycine max
tcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgttcaaaaaaaatt

SEQ ID NO: 7738 - DNA, 1979 bp, Glycine max
taccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtccttc

SEQ ID NO: 7739 - DNA, 1992 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagtacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtcc

SEQ ID NO: 7740 - DNA, 1965 bp, Glycine max
aataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtt

SEQ ID NO: 7741 - DNA, 1815 bp, Glycine max
gagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtc

SEQ ID NO: 7742 - DNA, 1991 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaagggaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtt

SEQ ID NO: 7743 - DNA, 2210 bp, Glycine max
ggaatatttacattgccagatttgatctctgggataattttgccaagtttgctgaaacttgatagagcaacatctgtgctctctataagatcaatagagcttaagcaaaatggtattccatcctttgacatttgaacaggacagtcaagaacatccacaccatctgaaatagctttttccctagtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7744 - DNA, 1989 bp, Glycine max
tcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtt

SEQ ID NO: 7745 - DNA, 1979 bp, Glycine max
gtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgttc

SEQ ID NO: 7746 - DNA, 1989 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgtttaaaa

SEQ ID NO: 7747 - DNA, 1850 bp, Glycine max
aacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgttc

SEQ ID NO: 7748 - DNA, 1529 bp, Glycine max
tctgtctctttgctccatttcagtgctctgtcttctcccccaccaccgcactctctcagatattatcatttcatatcacacattcacatcctatcatcatcgacaacacgctatccccattgcttcttctcttctccctctctcgtttcctacttgacggcgccgtttcgttctccagaagatgcttctgagtacttcgcgctgcaactagacatgatgagttcaagtttcaagacatgggctgtgggatttgcacttggaaatgaaggagaggcaacgttggagagctgaagaggatgctttattacgttcttatgtcaaacagtatggtcctagggaatggaatcttgtgtctcagcgcatgaacacatatcttaacagggatgctaagtcgtgcttggagaggtggaagaactacctcaagcctggcatcaaaaaaggctctcttactgaagaagagcagcgccttgtcatccaccttcaagcaaaatatggaaacaaatggaagaaaatcgctgctgaagtcccagggcgcactgctaagcggttaggcaagtggtgggaagtcttcaaagagaagcagcagagagagaaaaaggagatcaatagaattgccgacccaattaacaatagtaagtacgagcacatactcgagagttttgcagagaaactagttaaggaacgcccttcaccatcatttgtcatggctgcttccgatggggcatttctgctcactgatacaccagcacctgcatcttccttgcgtccttcttggctttccaattctagtagtgctgcagccatcggcccaagttccctttctgtgaaactaagtctttcttcctcaacggtggccacacctccattttcatggttgccacccgagagaggaccagacaatgctccttttgttttggggaatgtatcagcgcttcatggagctattccaactctaagtgatagcatgcatatgtctcagatggtggagcactgtaaagagttgggagaggggcatcgtgctttggccacgcacaagaaggaggcagcttggaggttaagtcgggtggagttacagttggagtcagagaaggccaaccgaagaagggagaagattgaagaatttgaagcaaagattaaagctcttcaggaagaggagaaagctgctttaggtagaattgaagcagaatacagagaacagttagctgcattgaggagagatgctgaaaacaaggagcaaaagttggcagaacaatgggatgcaaagcatttacggtttactaggttactagagcaattaggatgcagagcagggctccttgagccaaatgcaagatgaagatatattttggcaaaatggatattggtgctcttctgactaaaattatatgcagtttgtgatcttggtatatttttattttagacgtgtatgaatttcctatctattcatacaacttgagtaacttccgttaacagttgaattacctgcatatggtatcacatccgagtttataaacttagttatattcctg

SEQ ID NO: 7749 - DNA, 1276 bp, Glycine max
cacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtc

SEQ ID NO: 7750 - DNA, 1071 bp, Glycine max
ctcatccagatcttgcaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaatattaagatattgttctctagc

SEQ ID NO: 7751 - DNA, 1846 bp, Glycine max
tgatgatgcaagaaagaaacaaagagaagggaaatatcaggagctagtgctaggtgcgagtactggagcaaaacgcgggtgtgtgtgactttcgttggagagagatgcagttccattcagaaactccaaacaaacatccctcgcgacaaccttaggaatctcgatcgccgaaaaaacctatgcagccccgaacacacacactctgcattccaacttgtttaaatcatgcctctcgattcacccttctctctcaataaatcttttggcctatgaaatcagattcttcgccaccgccacagtcataataaagttttatttttccaaataaagggaatggcgactcctgttgagcctcctaacgggatcagaactgaagggaagcattattattccatgtggcaaaccctgtttgagtttgattcaaaatacgtgcccatcaagccaattggccgcggagcatatgggattgtgtgctcttctgtgaatagagagacaaatgagaaggttgccatcaagaagatacagaatgcctttgaaaaccgggttgatgcactgaggactttgcgcgaactcaagcttcttcgccaccttcaccatgagaatgtgattgctttgaaggatatcatgatgcctgttcataggaatagtttcaaggatgtctatctagtttatgaactcatggacacggatttgcatcagattattaagtcttctcaagctttgtctaatgatcactgccagtatttcctctttcagttgctccgtggcttgaaatatcttcactcagctaacatccttcatcgtgacttgaaacctgggaatcttctaattaatgcaaattgtgacctaaaaatatgcgattttgggttagcacgtactaactgcagcaagaaccagttcatgaccgagtatgttgtcactcggtggtatagggcaccagagctcctactctgctgtgacaactatgggacatctattgatgtttggtcagttggatgcatctttgcagagcttcttggccgaaaaccgattttccctggttcagagtgtctcaaccagctgaagttgattatcaatatccttggtagtcagagggaggaggatattgaattcattgataatccaaaggcaaagaagtatatcaaatcacttccttattctcctggaagccccttttcgcgactttatcctaatgcgcatccattagcaattgatcttcttgcaaagatgcttgtttttgatccaaccaagaggattagtgtcactgaagcacttcaacacccttacatggcccctctgtatgatcctaactgtgaccctccagctgtcattccaattgatcttgacattgatgaggatctaggggaagagatgataagggagatgatgtggaaagaaatgcttcattaccatcccgaatctgcgatggagaatgcagggttgtgctaatgatatttacttcttttcacggttatgttcccttttgttggtgccaggatagttctaatatcataacttgcttcaaataattaggagggctttgtcatcagtgagctcattatatgttcctgttttctatttattgaaagcagagagaaacagcaaaatattatcttaaaaaaaattgtgttattgctgatgatgcattatagtctttaactgccatgttgagagattgattttttactgaactctgtattgtagttgcctcgttttgctgtacataaacatgttcctgtgtctttcataaaccattttgtaaattaagtctaatgtttatcaatagtgtgttaatgtttgaactttgaagttattttattttatttttttcctgcaagcggaacat

SEQ ID NO: 7752 - DNA, 1965 bp, Glycine max
gaggagggcatttggtttaccttgaaattggagatggcatattacaggaagtaaagcatgcccagctagagtatgagatttcatgcctggacataaatcccattggtgaaaaccccaatcacagtaatctagcagcagttggaatgtggacagacataagtgttagaattttttctcttcctgatctgagtctcatcacaaaggaacaattaggaggggagatcatacctcgttctgttcttctttgtgcctttgaagggatatcgtacttgctatgtgccctcggtgatggccatctcttaaactttatgttgaatactagtaccggtgaattaacagataggaaaaaggtatctctagggacacaacctataacactacggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaaggaagaattattgtttttgctgttgaagatggaaaactacagctaattgccgagaaagagacaaaaggagctgtttattgcttgaatgcatttaatggtaaattgcttgcagctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactgattttatattaatctgtgtagcttcgttgtttgtttgtttttttttttcttatttaatattgttcttccttttttttttgaggggttgggtgggggttaaaataacattatatgcttgtattttctccccgctttttaccttctgtttgcattttacaatacatggatcacaaatggtgtatgaaatggatgtcatgttctaagtttcaaaa

SEQ ID NO: 7753 - DNA, 1002 bp, Glycine max
aagcaaacaacaatggcgaaccctgaaggcagtagcagaggctctagatggtcccttaagggaaccactgctctcgttactggaggaacgcgtggaattgggcacgctgtggtggaggaactagcggagtttggtgccacagtgtacacttgttcgaggaatgaagaagagctgaatgcatgcttgaaggagtggaaagagaagggattttcggtttctgggttggtttgtgatgcgtcttctccaccccatagagagaacctcattcaacaagtggcctctgctttcaacggcaagctcaacatacttgtaaacaatgttggaacaaatgtgaggaagccgacaattgagtatacagccgaagaatattcaaaattgatggcaactaacttggactccacataccatttgtgccaacttgcatatcctcttcttaaagcatctggaaatggaagtattgtgtccatttcctctgttgcaagtcagacaagcgtaggttctggagccatttacgcagcaactaaagctgctattgatcagcttaccaaatattttgcttgtgaatgggcaaaagacaatataaggagcaacggtgttgcaccctggtataccataacttcacttgtggaacctttgcttgcgaacaaacagcttgttagtgagataatatctcgaacgccgataaagcggatggcagaaacacatgaagtttcatccttggtgactttcctttgcctgccagcagcatcctacatcactggacagattgtttcagttgatggaggattcactgctaatggatttcaacccagcatgagaatttcttaaagcaaaatggccatttttattgttggattgtgtgaacaaagtggtggccacttgagttttggaccatctatgatcaacttgttttgattggtcaataaattattttagtattttagaaatttgcattgtcattttcaacggctatcattgtgagatgatgggtgctcttggaac

SEQ ID NO: 7754 - DNA, 1144 bp, Glycine max
cgtaaaccctaatttcggaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgtttttatttgtgtggtgtctggaaatggcctatttcattcccaatccgtttcctccagtctctgggggatttgattgatgagaattgcttatggtgggtgtatttccttttccaatgaaatgctacaacatttactgc

SEQ ID NO: 7755 - DNA, 1649 bp, Glycine max
agcgacgctcaggaaaaactctaaactgtgaaaaaaccactgcgatcaatggcaacgatcaaggccgtgaaagctcgccagatcttcgacagccgtggaaatccaaccgtcgaagttgacgttattctcagcgatggaagcttccacagagccgccgtgcctagcggtgcttcaacaggtgtttatgaggctttggaattaagggatggaggctcagactacctcgggaaaggtgttctcaaggctgtggagaatgttaattcaattatagcacctgctctgcttggcaaggacccaacgaagcagactgaaattgacaattttatggtacagcagcttgatggaactgttaatgaatgggggtggtgcaagcagaagcttggagccaatgctattttggcagtgtcacttgctgtctgcaaggctggtgctgcagtgaagaaaattcctctgtacaagcacattgccaatctggctggaaacaagactttggtactgcctgtaccttcattcaatgttatcaatggaggctcacatgctggaaataagctagcaatgcaggaatttatgattctccctgttggggcatcttccttcaaagaagcaatgaaaatgggcgtagaagtataccatcatctaaaggctgttattaaaaagaaatacggtcaggatgctactaacgttggtgatgaaggtggctttgctcctaatatccaggaaaaccaagaaggtcttgagcttctgaagactgccattgccaaagctggttacactggaaaggttgtaattgggatggatgttgctgcttcagaattttatgataacaaggacaaaacctatgacttgaattttaaggaagagaataatgatggatcacagaaaatctcaggagacagcttaaagaatgtgtacaaatcatatgtgacagattatccaattgtgtccattgaggatccatttgatcaggatgactgggagcactatgcaaaattaacagctgaagttggccagcaggtgcagattgttggtgatgatctccttgtcaccaacccaaagcgggtggagaaagcaatcaaggagaaggcttgcaatgcccttctgttgaaggtgaatcaaattggtagtgtaactgaaagtattgaagctgtgagaatgtctaaacaagctggttggggtgtcatggctagccacaggagtggtgaaactgaggataccttcattgctgacctctcagttggattagcaactggtcagatcaagactggagctccctgccgatctgaaaggcttgccaagtacaaccagctcctgaggattgaggaggaacttggttctgctgctgtgtatgctggtgccaaattcagagcccccgtggagccctactgattgtttagcccaagattactaagcatcatttaaataagattctattgatgactgcataggacatgtattttttgcgaaaaataaacttgtctactacttcagagaatataggttttccgggcgtggaattttgaagcgagaaaataaggcagtagatgtatgcctgatgcctagtttatttgaaatctagctttagggggtgtttggtgcgacaaattgttttccagaatcataatttttgggaattaaaaaattttggtcgt

SEQ ID NO: 7756 - DNA, 1405 bp, Glycine max
acatttttgatcttccttcctctgaaacaagaaccaaaatggagaattcgaccgaagaatcccatctccgatcggaaaactccgtcacttacgagtccccttaccctatctacggcatgtcattctccccctcccacccccaccgcctcgccctcggcagcttcatcgaagaatacaacaaccgcgtcgacatcctctctttccaccctgacaccctttcggtaactccccacccttctctctccttcgaccacccttaccctcccaccaaactcatgttccacccccgcaaaccctccccttcctcttcctccgacctcctcgccacctccggcgactacctccgcctctgggagatccgtgataactccgtggatgccgtctccctcttcaacaacagcaagaccagcgagttctgcgcccccttaacctctttcgactggaacgacatcgaccccaaccgcatcgccacctccagcatcgacaccacctgcaccatctgggacatcgaacgcaccctcgtcgaaacccaactcatcgctcacgacaaggaggtttacgacatcgcctggggagaggccagagtcttcgcctccgtctccgccgacggctccgttagaatcttcgaccttcgcgacaaggagcactccaccatcatctacgagagcccccaccctgacacccctttgctccgcttggcttggaacaaacaggacctgaggtacatggccaccattttaatggacagtaataaagttgtgattttggatattaggtctcccactacccctgttgcggagttagagaggcaccgtgggagtgtgaacgccattgcttgggctcctcatagctccacgcatatttgttctgctggtgatgatactcaggctcttatttgggaattgcccacgcttgcttctcccactgggattgatcccgtctgcatgtactctgctggctgtgaaattaaccagctgcagtggtccgccgcccagcccgattggattgccattgcttttgccaacaagatgcagcttttgaaggtttgaggtcagaacaaacaattacacattctagccacttcattgtggcatagacatagcaacttctgatcacttgagtgactgagttatatatattattgtagttgtgcaaactagtttgccctcctcatgttttacttgtggcgaaattaacgatgttcaatttgtctgttaaagatggatttttaacctgttgtgaagtaagatttcttgtctgtgatgtggaagccatagctattagtttcttagttaacatgagaaatcacatgtagtatgtggaatcaattaccacacatccagattataggtcgtaaaatcttcagtgtttgtattcccatttgattttaaacaccctacctctg

SEQ ID NO: 7757 - DNA, 1622 bp, Glycine max
cgagtaattaatgtgaaaggaatgaatgatttttgtattgcaaaataaattagtgtacttcacatgacggattttcacgagcaacaataagcatagagagaaatttggcattgcagtgcatcatcgcattgattgagttggaagatgggtagcaaaggcaaacgcaaagagcaagaatcaataataacgagggttatggctcacggaggtagatacgtgcaatacaacgtgtacggaaacttgttcgaggtctcctccaagtatgtccctcccattcgccctgtcggtagaggcgcatacggcatcgtttgtgctgctgttaattgcgatacgcacgaggaagttgccataaagaagattggtaacgcctttgacaacatcattgacgctaaacgaactttgagggaaatcaagctccttcgccacatggaccatgaaaatataattgccattagggatatcatacgacctcccagaaaggatgccttcaatgatgtttacattgtttatgaattgatggacactgatcttcatcagattattcgttctgaccaacctcttaacgatgaccactgtcagtactttttatatcagctgttacgggggctgaaatatgtgcattctgctaatatcttgcaccgtgatcttaagcccagtaatttgcttctcaattcaaactgtgaccttaaaattgcggactttggtctggcaaggacaacatctgaaacggatttcatgacggagtatgttgtcacacgatggtaccgagccccagaattgcttcttaattgttcagagtacacctccgcgattgatgtttggtctgttggttgcatatttggtgaaattatgaccagagaacccttgtttcctggaaaagattatgttcatcaactgaggcttataacagagttattaggttcacctgatgatgccagccttggatttctccgaagtggaaatgccaaaagatatgttcgacagcttccacaatataggaagcaaaatttctccgctagattcccaaatatgtctcctgaggcattggatctactagaaaagatgcttatctttgatcccaacaaacgcattacagttgatgaagcactatgtcatccatatctttcatcacttcatgacatcaatgatgaaccggttggtcctgggcaattcaattttgattttgagcagccaacatgcactgaagagcacatcaaggagctcatctggagggaatcggtgaagtacaatccagatccacccagtcagtaattctttcttgaatgatgattcccttattactcttgggtgtagacatccagagagagataagtgattgatatgattagtaatgtattgtgacaaaaagagagatattgagaaatgagaggtgtgtaagggtggtgagagaatccttattcttctttcttattagtataaatgtatcaagataaacttctttcaccttaaatacagtgcctgttcattattcagataagttgctgcacacagaaagtcagaaactttgttcttgtaatctagtcctaagcatttagaatacaaaggaaaatgaatattcattaggaatccaattgaatattgctagcattcagacaagttat

SEQ ID NO: 7758 - DNA, 1178 bp, Glycine max
gagggggtcagagtgagaaagagaaagagagaattcgtaaaccctaatttcggaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaactcctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgttttatttgtgtggtgtctggaaatggcctatttcattcccaatccgtttcctccagtctctgggggatttgattgatgagaattgcttatggtgggtgtatttccttttccaatgaaatgctacaacatttactgc

SEQ ID NO: 7759 - DNA, 1287 bp, Glycine max
ccttcagttggaatctcagctggtgatgagatttgggcagctcgttacatcttggagaggatcactgagattgctggtgtggtggtttcctttgaccccaagccaattaagggtgattggaatggtgctggtgctcacacaaactacagcaccaagtccatgagagaagatggtggctatgaagtgatcaaagcagcaattgacaagttggggaagaagcacaaggagcacattgctgcttatggagaaggcaacgaacgtcgtttgacaggacgccacgaaaccgctgacatcaacaccttcttatggggagttgcaaaccctctctctccctccaccttaaccctctccccacgcgcccttctccctccctcacgcgcccttctctctccctcacgcgcccttctcactctcgccgctccttcgttgtcaaagcctcctccagcgagcttccgctggttggtaacaccgcaccggatttcgaagcagaggctgtgtttgaccaggagtttatcaacgtgaaactatctgattacattgggaagaaatatgttgtgctcttcttctacccgttggacttcacctttgtctgccccacagaaatcactgctttcagtgaccgacatgcagagttcgaggcactaaatactgagatattgggtgtttcagttgacagtgtgttctcgcaccttgcatggatccaaacagatagaaagtcaggtggccttggtgacttgaactatcctttgatttctgatgtcaccaaatccatatcgaaatcttatggtgttctcattcctgatcagggaattgcattgagaggattgttcattattgacaaggaaggggttattcagcattctaccattaacaacttggcaattggtagaagtgttgacgagacaaagagaactctccaggccttacagtatgtgcaggagaacccagatgaagtttgccctgctgggtggaagcctggggagaagtccatgaaaccagaccctaaacttagcaaagactactttgcagcggtgtagctaggataatagttaagagtggctatctgcatctgtatcaatcagtgaattgcaaaagggtcttgttttttttaatgttttgtaagtccttaaattttgagccgcagggtttggtaatatgcgtgctggtgtactggattttgaagtgtactatgtattaatttgcaatttctgttcattatgatctctgtatttcgtgttcatatatgaaccttatcttttgccaaggctggagttccagcaagttatc

SEQ ID NO: 7760 - DNA, 616 bp, Glycine max
ctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgtagcc

SEQ ID NO: 7761 - DNA, 1418 bp, Glycine max
atgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagc

SEQ ID NO: 7762 - DNA, 1980 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttt

SEQ ID NO: 7763 - DNA, 1967 bp, Glycine max
aaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtcc

SEQ ID NO: 7764 - DNA, 1988 bp, Glycine max
caatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtc

SEQ ID NO: 7765 - DNA, 1457 bp, Glycine max
gtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgtagccttc

SEQ ID NO: 7766 - DNA, 1232 bp, Glycine max
aacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtccttc

SEQ ID NO: 7767 - DNA, 1469 bp, Glycine max
tatatatactatgatgagagtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgt

SEQ ID NO: 7768 - DNA, 1992 bp, Glycine max
caatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtccttc

SEQ ID NO: 7769 - DNA, 1989 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtg

SEQ ID NO: 7770 - DNA, 1989 bp, Glycine max
tcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtc

SEQ ID NO: 7771 - DNA, 1455 bp, Glycine max
gcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgtagccttc

SEQ ID NO: 7772 - DNA, 2222 bp, Glycine max
gcaaaggattatggaagttatgctctctccttcacatcccttgccttatcagtaaggtacccttttgcatagtcaagggtgtcagaacccgcaggctggttcccagaaacgtagttgtaaatccaagataaagcagcaatggcagccacaccacagcccccagagaacaaaaagccagaagcaaccaggaacagcacaaacgcagcagggacaaggatggggctgagttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactcccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtccttc

SEQ ID NO: 7773 - DNA, 2020 bp, Glycine max
gtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7774 - DNA, 1257 bp, Glycine max
cgaaaacagtgttccaaaatccaaacacactctctctccccatggcgttgaacaatggcgtccccgccaccggcaccggcctcatcgtcagcttcggtgagatgctcatcgacttcgtccccaccgtctctggcgtgtccctggccgaggcccctggcttcctcaaggcccccggcggcgcccccgctaacgtcgccatcgccgtgtcgcgcctcggcggcaaagccgccttcgtcggcaagctcggcgacgacgagttcggccacatgctcgccggaatcctcaaggaaaacggcgttcgcgccgacggcatcaactttgaccagggcgcacgcaccgccctggccttcgtgaccctacgcgccgacggggagcgtgagttcatgttctacagaaaccccagcgccgacatgctcctcaagcccgaagaactcaatctcgaactcatcagatctgcaaaagttttccattacggatcaatcagtttgatcgtggagccatgcagatcagcacacttgaaggcaatggaagtagccaaggaatctgggtgcttgctctcctatgaccccaaccttcgtctacctttgtggccttcggctgaggaagctcgtaagcaaatactgagcatttgggagaaggctgatttgatcaaggtcagtgatgcggagcttgagttcctcacaggaagtgacaagattgatgatgaatctgctttgtcattgtggcaccccaatttgaagttgctccttgtcactcttggggaacatggttccagatactacaccaagagtttcaaaggatcggtagatgctttccatgtcaatacagttgatacaactggtgccggtgattcctttgttggtgctttattggccaagattgtcgatgatcagtccatacttgaagatgaaccaaggttaagagaagtactaaagtttgcaaatgcatgtggagctattacaactacccaaaagggagcaattccggcccttcccaaagaggaggctgcactgaaactgatcaaaggggggtcatagaatcttttggcaaaatgcaaaagtgctagcatgatttcgttttcttcccctaatgtttaaattttccgttggatttgcttgctataagtttaggagggaacttttgttttttctcctatgcactgttttcaggttttgccaaataacgctttctttcaaattttgagattagcgattgaatgaaaatttgaatcataagctcggcccatagttgcaactt

SEQ ID NO: 7775 - DNA, 1450 bp, Glycine max
gtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgt

SEQ ID NO: 7776 - DNA, 2040 bp, Glycine max
gttcaatatcctagtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7777 - DNA, 2038 bp, Glycine max
tcaatatcctagtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7778 - DNA, 1991 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtc

SEQ ID NO: 7779 - DNA, 1992 bp, Glycine max
tcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtcctt

SEQ ID NO: 7780 - DNA, 1989 bp, Glycine max; identical to SEQ ID NO: 7770

SEQ ID NO: 7781 - DNA, 1988 bp, Glycine max; identical to SEQ ID NO: 7764

SEQ ID NO: 7782 - DNA, 1975 bp, Glycine max
accttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtcc

SEQ ID NO: 7783 - DNA, 1481 bp, Glycine max
attcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgct

SEQ ID NO: 7784 - DNA, 1299 bp, Glycine max
tccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7785 - DNA, 1991 bp, Glycine max; identical to SEQ ID NO: 7778

SEQ ID NO: 7786 - DNA, 1156 bp, Glycine max
ggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcagggcgaagagcaaaagaaactggatgtcctttccaatgatgtctttatcaaggctttggtcagcagtggacgaacatgcatcttggtgtctgaagaagatgaggaagcaacatttgtggaagcttctaagcgtggaaaatactgtgttgtttttgacccgctggatggttcttctaacattgattgtggtgtttcaattggcacaatctttgggatttatttgataaaagaagaccatgaaccaaccattgaagatgttttgcaacccgggaagaacatgttggcagctggttattgtatgtatggaagctcttgcacgcttgtgttaagcactggaagtggtgttaatggtttcacccttgatccatctcttggggaattcattctaactcaccctgacatcaagattccaaagaaaggcaagatctattcagtgaatgaaggaaatgctaaaaactgggatgaccctactaccaagtatgtggagaactgcaagtatccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggcaaccaaagggcacttgatttggttccaaagaagttgcacgagcgatctcccatattccttggtagctatgaggatgtcgaggaaatcaaggctctttacgctgctgaggaatgaagctggaagaaagcattctttgtctttcgctacttacaagcaattgttatctaattgttacacacatacatggtcatgtatatgttaagaaaacttgttaatgttttgtgctttagaaaaattatttcattagttatatct

SEQ ID NO: 7787 - DNA, 991 bp, Glycine max
atcctctctgtatctttggttcagcagccattagcgatttcccttatctctctccatcttaactccaagcacaagaatcatcttcccatttcgtttctgaccaatggcttccctcactgtcccaaaccattgtgttcccactttgcttcgcactcactctctcaactacccatcttcccaaaacctcccacttccttccgcgccatcaaattctcaattttttggcctcaagctatctcattcttccttttccacaattccctcttcttcttcttcactcaaaggctccattttcgccaaggtgactaaaggttcaaagccaccgaattttacgctaaaagatcagaacgggaagaatgttagcctctccaacttcaaaggaaaaccagtagttgtgtatttctaccctgctgatgagacccctggctgtaccaaacaggcttgcgctttcagggattcatatgagaagttcaagaaagcaggagcggtggttgttgggataagtggtgatgatgctgcctctcacaaggcatttgccagcaagtacaaacttccatttactttgttgagtgatgagggtaacaaggtgaggaaagaatggggagtgccaggtgatttctttggatcattgcctggaagagagacttatgttcttgacaaaaatggggtggttcagctcgtctacaacaatcagttccaaccagaaaagcatattggtgagaccctgaaaatacttcagagtctttgagacattctgattcttttgttggctatcttagctggcctgattcagagtcagacaagtatgtaactatgaattgtaagtttgtaaccactgtaattatgtagctgattttggagcctttgatcacattcacatgggggtgatgatatgtattctcctatagagagcaaacatttataacctctccggatggaataatgccttcatttgccacaaatacaatcagattatatctgtatcttttgc

SEQ ID NO: 7788 - DNA, 2045 bp, Glycine max
gtagtagagcactgaattggatatgtgtctatcacctaatctaagtcatcgtgtggtggtggttttggtcggtggcaaagagagaagaaacaaagcctgttcttcttaccatgtcggatcatcttccgcgcgaagtgctaaccgaaatcctctcccggttaccggtcagatccctactgagattccggtcaacgtccaagtcatggaagtccttaatcgacagccagcacttgaactggcttcatctgactagatccctgaccttagcctccaacacgagcctcatcctccgtgtggactccgatctataccagaccaatttcccaaccctagaccctcccgtatcccttaaccaccctctcatgtgctacagcaacagcataaccctcctcggttcctgcaacggccttctctgtatatccaacgtcgccgacgacatcgccttttggaacccctccctccgccaacaccgtattcttccttacctccctgtcccccgccgccgtcaccccgacacgacgctctttgccgcccgcgtctgcggcttcggcttcgaccataaaactcgcgactacaagctcgtccgcatctcttatttcgtcgaccttcatgaccgctccttcgactcccaggtcaagctctacacgctccgcgccaacgcctggaagacacttcccagcttgccctacgcgctctgctgcgcccgtaccatgggcgtcttcgtcggaaactccctccactgggtcgtcacgcgcaaactcgaacccgaccaacccgatctcatcatcgccttcgatctcacccacgacatcttccgcgagctcccgcttcctgacaccggaggtgtcgacggcgggttcgagatcgacctggcgctgttaggtggttccctctgcatgaccgtgaactttcacaaaacgagaatcgacgtttgggtgatgagggagtataaccgtagagacagttggtgtaaggtgttcacgctcgaggagtcgcgtgagatgagatcgttgaaatgcgtgaggccgttgggctactcgagcgatgggaacaaggttctgttggaacacgacaggaagaggctgttttggtatgacctggaaaagaaagaggttgcccttgttaaaattcagggtttgcctaatttaaatgaagccatgatttgtttgggaaccctcgtaccaccatacttcttacctcgtcaaatttgtaggaagccgcgtgctttaggatgcgaacgtcccaggaagacgagggatgacttcctgtcgcagggtttcaaattgacattatgaggaagtctaagaagaagaagcaatggtacatgggggtagctgaaactggctcggcgggtttgttttgcagttgattcaagccaaagggaggttgaggaaaagtaagaaaatgttgcttccgttacaatgactgtaatgtatagttaaattaatactatcagctacatattttactttgggatgtgtgccacgtttgacgaactctgaaacaaacatgctcttattggttacttgctgagttatctgactctgatgatgaaattcgtggccctggttcacaggacgagttaaattgatcaagagcaggaacagagacaccgttttgcctgttaagatataagactctttccttgtacagtttttgcaccttttgttttcttagcgatttaggggcgaacaaagccccccaccaaagtgaaagaaagggctgcagacctgccattcagaatgttgaagaaggaaacaatgactgaagaacagataccaaatatacaaatgctgctttcctcacttattaacagtctccaattactaagatcccgtaagacactcgctttccgcaatagaaaaaaaatggcctatatggttttgtctaagcttggattgcctcagtggtttggttgtaaagaagtgtcatgtatgtacgtgtgttaatctggttgtaccagcaaactgtaattaaatttttgcagttaacttgacatgaaatattgttgtttttgtttattggtaggtggactttgcaaattg

SEQ ID NO: 7789 - DNA, 1448 bp, Glycine max
aacatttttgatcttccttcctctgaaacaagaaccaaaatggagaattcgaccgaagaatcccatctccgatcggaaaactccgtcacttacgagtccccttaccctatctacggcatgtcattctccccctcccacccccaccgcctcgccctcggcagcttcatcgaagaatacaacaaccgcgtcgacatcctctctttccaccctgacaccctttcggtaactccccacccttctctctccttcgaccacccttaccctcccaccaaactcatgttccacccccgcaaaccctccccttcctcttcctccgacctcctcgccacctccggcgactacctccgcctctgggagatccgtgataactccgtggatgccgtctccctcttcaacaacagcaagaccagcgagttctgcgcccccttaacctctttcgactggaacgacatcgaccccaaccgcatcgccacctccagcatcgacaccacctgcaccatctgggacatcgaacgcaccctcgtcgaaacccaactcatcgctcacgacaaggaggtttacgacatcgcctggggagaggccagagtcttcgcctccgtctccgccgacggctccgttagaatcttcgaccttcgcgacaaggagcactccaccatcatctacgagagcccccaccctgacacccctttgctccgcttggcttggaacaaacaggacctgaggtacatggccaccattttaatggacagtaataaagttgtgattttggatattaggtctcccactacccctgttgcggagttagagaggcaccgtgggagtgtgaacgccattgcttgggctcctcatagctccacgcatatttgttctgctggtgatgatactcaggctcttatttgggaattgcccacgcttgcttctcccactgggattgatcccgtctgcatgtactctgctggctgtgaaattaaccagctgcagtggtccgccgcccagcccgattggattgccattgcttttgccaacaagatgcagcttttgaaggtttgaggtcagaacaaacaattacacattctagccacttcattgtggcatagacatagcaacttctgatcacttgagtgactgagttatatatattattgtagttgtgcaaactagtttgccctcctcatgttttacttgtggcgaaattaacgatgttcaatttgtctgttaaagatggatttttaacctgttgtgaagtaagatttcttgtctgtgatgtggaagccatagctattagtttcttagttaacatgagaaatcacatgtagtatgtggaatcaattaccacacatccagattataggtcgtaaaatcttcagtgtttgtattcccatttgattttaaacaccctacctctgatatgtatggactatggatctgtattcttgagcttttgccat

SEQ ID NO: 7790 - DNA, 1027 bp, Glycine max
ggttaagcggtgagatttgcgaatctgagaaatggcggattcttctcgggaggagaacgtttacatggcgaaattggcggagcaggccgagcgttacgaggagatggttgagttcatggagaaggttgcaaagactgtggaggttgaggagttgacggtggaggagaggaatctcctctctgtggcttacaagaacgtgattggtgcgaggagggcttcgtggaggatcatatcctccattgagcagaaggaggagagcaggggcaatgaggaccacgtggccattataaaggagtacaggggcaaaattgaggctgaactcagcaagatctgtgatgggattttgaacctccttgagtccaacctcattccttccgctgcatctcccgagagcaaagtcttttaccttaaaatgaagggtgattaccacaggtaccttgctgagttcaagaccggggcagagaggaaagaggctgcagagagtactttgcttgcttacaaatccgctcaggatattgctcttgctgacttggcccccactcaccccattaggttgggacttgctctcaacttttctgtgttctattatgaaatccttaactcgccagatcgtgcttgtaatcttgccaagcaggcatttgatgaggcaatttccgagcttgacacattgggtgaagagtcatacaaagatagtacattgatcatgcaacttctccgtgacaatctgactttgtggacatcagacatcacggacgatgctggagatgagatcaaggaaacatctaagcaacaaccaggcgaataggcgatggcagttgcgatgtggtagttgattggatatgtattaccgataatatggatccaatgtggcttgccatagtgggattattgtattaatgaattttatgatttcaagtgcgcgttgcgcttgggatttacaatgtttcagtggattgtctaatgtgttttatggatgagaagaatgtggtttagtgatttataaattttttattgttgctagtaaaaa

SEQ ID NO: 7791 - DNA, 1094 bp, Glycine max
ttttttctttctccgccccttttttgttgttccttcttctcgttcgtcgctttgtgatctctctctgcaaccatgtccgtcgagaaagagagagagacccaggtttacttggccaagcttgccgagcaggccgagagatacgaagaaatggttgagtgtatgaagaaagtagcaaaacttgatcttgatctgactgtggaagaaaggaaccttctctcagtgggatacaaaaatgtgattggtgcacgaagggcctcttggcgcataatgtcctcaattgagcagaaggaagagtctaagggaaatgagcacaatgttaaactgatcaagagttactgccaaaaagttgaggaggaactctccaaaatctgtggtgacattctgactattatagaccagcatttgattccttcttccggatcagcagaagctagcgttttctactacaagatgaaaggtgattattttcggtatcttgctgagttcaagactgaccaagaaaggaaagaggcagctgagcagtcactaaaaggatacgaggctgcttctgccactgcaaacacagatcttccatcaacacatccaatccgtcttggacttgcactcaatttctctgtcttttattatgagataatgaactctcctgaaagggcctgccatttggccaagcaagcttttgatgaggcaattgcggagttggacaccctgagtgaagagtcatacaaggacagcactttgatcatgcagctgttgagagacaaccttactctctggacttccgatttaccagaggatggaggtgaggacaacataaaagctgaagaagccaaaccttctgagcctgagcattgatgtgattcagtagtcagaaatctaaggtactccccaagagggcatttttcagcttttcttgcaatggatttggaccggacaatagggactgtggtggccatttcataattcttgttctctcttaatatctttaccaaagccagaagatctgcacccttttttttcccttaaaactttttatttttattgccttctctgttttaagtggtcagttaagcaatgaacaatttacatttaccctt

SEQ ID NO: 7792 - DNA, 1043 bp, Glycine max
ctttctctctctctctctctcacccagatcttgtagcaatggcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccattataa

SEQ ID NO: 7793 - DNA, 3048 bp, Glycine max
gtttcgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggttttggcgctctcgagttcgttttgtactgttttacgtgtgacatgtgaattggaatgcttattccagcttatacaaaacagagacggatctcttcctattgttctcgctttgtttcttttgcagtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccatgcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggtttgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattc

SEQ ID NO: 7794 - DNA, 889 bp, Glycine max
ggatttttcaaaagggaaggtacatggaacacagaatatggacaattcttccttgactggtactccaccaaacttgttgaacatggtgagaaaatccttgtatcagccaaaggcatattcaactcatgtggggtgaaactatctgccaaagtagctggaattcattggcactacaagactaggtcacacgcggctgaactaactgcaggctactacaacacgcggtttcgcgatggatacctaccaatagcacaaatggtggcaaaacatggagttgtgttaaacttcacctgcatggaaatgagggacagagagcaacatgagcattgttcccctgaggggttggttcatcaagtgaagatggcagccagaacagcaggagcagaacttgctggggagaatgcacttgagagatatgatgcaggtgcattttctcaagttctgtcaacaagtaactctggttctggattggctgcattcacttatctgagaatgaataggaggttgtttgagggagacaattggaggcactttgtggagtttgtgaaatgcatgtctgaaggtggaaagagacaaaggcttcctcaatctgattcttgtgggactcatctttatgttggacacatcacaggaattcagaagcagcaagagcaagctcaagaggttgctcttgtgtgaataagtatagcatcatgtggaggggtcactgtgtatactgtctagttaagttaaaagcatcatagttttatagaagagaaaaagagatagaattatgatgggtatacgcaaggaaaatggcgtattctagaccaaaccctgagatcattaggaaaaatattgttttatttcatgttagaaatccaataagtgctgtgcggttaattcccgc

SEQ ID NO: 7795 - DNA, 1094 bp, Glycine max
ctctctctctttctctttctctctcatccagatcttgcaaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaatattaagatattgttctctagc

SEQ ID NO: 7796 - DNA, 1337 bp, Glycine max
gtgtgcaccattgtcgccttgcgtgcgccggttgcgcagccccctatcttgcgcatccccaatcacctcatcgaaactactaacaccttcacaatcgttcaccagcgctacagaacccagatctcgggttccaatcgtcgagccatgtccaaggcacgcgtctacaccgatgtcaatgttcttcgccccaaagagtactgggattacgagtccctcaccgttcaatggggtgatcaagatgattatgaggttgtgcgcaaagtgggaaggggaaagtacagtgaggtttttgaaggcataaatgttaatagcaatgagcgttgtgtaatcaagattctcaagcctgtcaagaaaaagaagattaaaagagagataaaaatacttcagaacctttgtggggggccaaatattgtcaagcttcttgatattgtcagagatcagcactctaaaactcctagcttaatatttgagtatgtcaacagtacagattttaaagttttgtatccaaccttgactgattatgacatacgctattacatatatgagcttcttaaggccttagattactgtcattctcaaggcataatgcatagagatgtcaagcctcataatgttatgatagatcatgaattacggaaacttcgcttgatagattggggtcttgctgaattttatcatcctggaaaggaatacaatgttcgtgtggcttcaagatactttaagggccctgaacttctagttgatttacaagactatgactactcattagacatgtggagtcttggctgcatgtttgctggaatgatatttcgcaaggaaccttttttttatggtcacgacaaccatgatcagcttgtcaaaatagctaaggtgcttgggacagatgaactgaatgcatatctgaataagtatcatctggagcttgatcctcaacttgatgcactggttggaaggcacagtcgcaagccttggtctaaatttatcaatgcagataatcaacatcttgtgtctcctgaggcaattgattttcttgataaactccttcgatacgatcaccaggacaggctaacagcaagagaagcaatggcacatccatatttctctcaagtaagggcagctgaaagtagcagaatgaggacacagtaacttaaatcattggatccatcagcctgagtttcatatatgtgggattgttttataatacaccctcaaatgtggcatggttgccttctgttaaaattatagtttgttagttttgttgtggaatgtaactatatcataacttgttccagctgaataatttgttagcctgctgttgaaaattcaaattctatctt

SEQ ID NO: 7797 - DNA, 1063 bp, Glycine max
gcgaatccctctctctctttctctttctctctcatccagatcttgcaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccatt

SEQ ID NO: 7798 - DNA, 1122 bp, Glycine max
cgcgtttggctttagcatttagcattttctctctctctctctccacgctgttactttatcatataacctgactcaccccacccaatcctattcccatcccatttgaacctctccttctcgcagagtgagcgagcaagcgaatatcccaatcccacaccaatggcatgctcagccacctctgcttccctcttctccgcaaacccaacacccctcttctctcccaaaccctctctctccctccaccttaaccctctccccacgcgcccttctccctccctcacgcgcccttctctctccctcacgcgcccttctcactctcgccgctccttcgttgtcaaagcctcctccagcgagcttccgctggttggtaacaccgcaccggatttcgaagcagaggctgtgtttgaccaggagtttatcaacgtgaaactatctgattacattgggaagaaatatgttgtgctcttcttctacccgttggacttcacctttgtctgccccacagaaatcactgctttcagtgaccgacatgcagagttcgaggcactaaatactgagatattgggtgtttcagttgacagtgtgttctcgcaccttgcatggatccaaacagatagaaagtcaggtggccttggtgacttgaactatcctttgatttctgatgtcaccaaatccatatcgaaatcttatggtgttctcattcctgatcagggaattgcattgagaggattgttcattattgacaaggaaggggttattcagcattctaccattaacaacttggcaattggtagaagtgttgacgagacaaagagaactctccaggccttacagtatgtgcaggagaacccagatgaagtttgccctgctgggtggaagcctggggagaagtccatgaaaccagaccctaaacttagcaaagactactttgcagcggtgtagctaggataatagttaagagtggctatctgcatctgtatcaatcagtgaattgcaaaagggtcttgttttttttaatgttttgtaagtccttaaattttgagccgcagggtttggtaatatgcgtgctggtgtactggattttgaagtgtactatgtattaatttgcaatttctgttcatt

SEQ ID NO: 7799 - DNA, 1113 bp, Glycine max
gtgtttctttttttggttgtttgttctttcttctcgttcgtcgctttgtgatctctctctgcaaccatgtccgccgagaaagagagagagacccaggtttacttggccaagcttgccgagcaggccgagagatacgaagaaatggttgagtgtatgaagaaagtagcaaaacttgatcttgatctaactgtggaagaaaggaacctcctctcagtgggatacaaaaatgtgattggtgcacgaagggcctcttggcgcatcatgtcctcaattgagcagaaggaagagtctaagggaaatgagcacaatgttaaactgatcaagagttactgccaaaaagttgaggaggaactctccaaaatttgtggggacattctgactattatagaccagcatttgattccttcttccgcatcagcagaagctagtgttttctactataagatgaaaggtgattattttcggtatcttgctgagttcaagactgaccaagaaaggaaagaggcagctgaacagtcactgaaaggatacgaggctgcttcagccactgcaaacacagatcttccatcaacacatccaatccgtcttggacttgcactcaatttctctgtcttttattatgagataatgaactctcctgaaagggcctgccatttggctaagcaagcttttgatgaggcaattgcggagttggacaccctgagtgaagagtcatacaaggacagcactttgatcatgcagctgttgagagacaacctgactctctggacctctgatttgcctgaggatggaggtgaggacagcataaaagctgaagaaaccaaaccttctgagcctgagcattgatgtgattcaatagtcagaaatctaaggtactctcaaagaggacattttctagcaatggatttggacccggacaatagggactgtggttggtggccatttcataattcttatgctctcttaatatctttaccaaagctagaagatctgcaccctttttttttccttcaaacttttttcttattaccttctctctgttttaagtaaaatggtcagttaagcaatgaacaatttacatttacccttataagcatcttcattccttcgttc

SEQ ID NO: 7800 - DNA, 2117 bp, Glycine max
tggaaggcttcagtactaagagccagccctgcacatatgataagagcaagctatgcaagccagcccttgcgactgcattgtttagcactgtatctttcttgcttggtgctataacttcagtcctatctggtttccttgggatgaaaattgcaacctatgccaatgcaaggacaaccttggaagccagaaagggagttggaaaggctttcattactgcatttaggtctggtgcagtgatgggtttccttcttgcagcaaatggtcttttggtgctctacattaccatcaatctcttcaagctatattatggtgatgattgggaaggtctttttgaggctataactggttatggtttgggtggatcttccatggctctgtttggcagagttggtggtggtatctacaccaaggctgctgatgttggggctgatctggttggaaaagttgaaagaaatatcccagaggatgatccaagaaacccagctgtgattgctgacaatgttggtgataatgttggagatattgctgggatgggttctgatctttttggttcatatgccgaatcgtcttgtgctgccttagttgttgcatccatttcctcatttggaatcaaccatgagttcactgcaatgttatatcccctactcatcagttctatgggcattattgtctgtttgattactactctctttgcaactgatttctttgagatcaaggctgtcaaggaaattgaaccagctttgaaaaagcagcttatcatctctacagtactcatgactgttggaattgcaattattagttggattgctctgccaacatccttcacaattttcaactttggcgctcagaaggaagtaaagagctggcagctgttcctctgtgtgggtgttggtctatgggctggacttattattggttttgttacagagtattatacaagcaatgcttacagccctgtacaagatgttgctgattcctgccggactggagctgcaaccaatgtcatctttggccttgctctgggatacaagtctgtcattattcctatttttgccatcgcaatcagcatttttgtgagttttacttttgctgcaatgtatggcattgctgtggctgcccttgggatgctgagcaccattgcgacagggttggctattgatgcctatgggccaatcagtgacaatgcaggaggtattgctgagatggcaggcatgagccatcgtattcgtgagagaactgatgcccttgatgctgctggcaacactactgctgccataggcaagggatttgctattgggtctgctgctttggtgtctttggccctatttggtgcatttgtgagcagagctggaattttgactgttgatgtcttgactcccaaggtctttattggactcatagttggtgccatgcttccttactggttttctgccatgaccatgaagagtgttggaagtgcagctttgaagatggttgaggaggttcgtaggcagttcaacaccattccaggactgatggagggtcatgccaagcctgattatgccacctgcgtcaaaatttctactgatgcatccatcaaggagatgattcctccgggtgcccttgtcatgctcacaccactcattgttggaatcttcttcggggtggaaacactttcaggtgttcttgccggggctctagtttctggtgtacagattgcaatatcagcatccaacactggcggtgcttgggataatgctaagaagtacatagaggctggtgcgtctgagcatgcaaggaccctgggcccgaagggatctgaaccacataaggcagctgttattggagataccattggagaccctcttaaagatacttcaggtccttcactcaacatcctcatcaagctcatggccgttgagtcgctcgtcttcgcaccatttttcgccactcacggtggcctgcttttcaagatcttttgatttgagggtagagttttctatcaatttatcctatttttctcggagcctgcagcaggcatttttctttgtaccaatataccctctccacctttaggggtagctcttctaattatcaggacttgctcttcaaattatcaggacttgaaatttgttact

SEQ ID NO: 7801 - DNA, 1469 bp, Glycine max; identical to SEQ ID NO: 7767

SEQ ID NO: 7802 - DNA, 2022 bp, Glycine max
ccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7803 - DNA, 1662 bp, Glycine max
gagaaagagaacatccacaaccacacccaccacacgaggagagaggacgtagagaaagaggacgccaggaaggtgagaaggaggaaaaggaacaagacgagcgtgaattacaaccacgtccatttccacgaccagaggagcatgaaggagaacagtggaaaggaaggcatcgtcatgaagacccggaagagagggcgagaatgagactgagggaagcagaaagaatagagagggaaagggaggaacagagggtgagggaggaggaagagaaactccggcgacgtgagaagaaggaacaacgggaagagaaagaagaagaaggtcaaggttcggaagactcacactcaaaaagacagaacaacccttttcacttcagctctaacaggttccaaacgctcttcaagaaccaacatggtcaccttcgcgtcctccagagattcgaccaacgctccccacaacttgagaaccttcgagactaccgtgttgtagagctcatggctaaacccaacaccctctttctcccccaccacgctgacgctgattttctcctccttgtccttagcgggagagccttaattaacttggtgaaacccgacgacagagacccctactaccttgaccgtggttatgcacaaagaatccctgcaggaaccactgtctatttggttaacccggacaagaagaaagatctcagagtgattaaactcgccatacccgttaacaaacctggcaattttgaggatttcttcctatctagcactcaagaccagcaatcctacttgcaaggcttcagcgagaatattctggaggcttccttcaataccaaattcgaggagataaacagggttttgtttggtggagaggggaggcggcaccagcaagagggagtgattttggaactatcaaaggaacagattcgggaactgagcaagcgtgccaaatctagttcaaggagtactaattccttcgattatgaaccattctacttgagaggctcccaaatctcttccaacaactttggaaagttctatgagatcacccctgagaagaacccccagcttcgggactttgatatcctcctcaatactgtggatatcaacgagggaggtcttcttctgccacactacaattcaaaggccatagtgatactaatggttactgaaggagaagcaaacattgaactcgttggcctaaaagaacagcaacagggagaggaaacaagggaagtgcgaaagtatagagccgagttgtctgaagacgatatatttgtaatcccagcagcttatccatttgtggtcaacgctacctcaaacctcaatttcgttgcttttggtatcaatgctgagaacaaccagaggaacttccttgcaggttcgaaagacaatgtgataagacagatacaaaaacaggtgaaggagcttgcgttccctgctgggtctgcacaagatatcgagaatctaataaagaaccagagggaatcctattttgctgatgctcagcctttgcaaaaggaggaagggaagaaagggtcctttgtcttttgaatatgtatgcttaggagactaggagttcacagcgagcgaggaaagtatagggatatgtaactagaataacttgagatccacctttctactactagtaaataaaataaataaatcgagc

SEQ ID NO: 7804 - DNA, 1471 bp, Glycine max
tatatactatgatgagagtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgtagcc

SEQ ID NO: 7805 - DNA, 1989 bp, Glycine max
actagttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttt

SEQ ID NO: 7806 - DNA, 2022 bp, Glycine max; identical to SEQ ID NO: 7802

SEQ ID NO: 7807 - DNA, 1555 bp, Glycine max
ggaagaggtgggcgtgggaatgggaattgacgttcatcttgttccttctgatgaggtgggcgtgggaatgggaattgacgttcatcttgttcctcatccgaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttt

SEQ ID NO: 7808 - DNA, 1723 bp, Glycine max
gaagcttcggtttctctctctctctctttctctttctcttagggttttcactttcaccaatttctccttctcttccgatctacgcccaaaggtatcacctcgcgtgcattcgttcctaatcctttcaaactctccgttctcccatctttaacttgtttaagctgctacgtttaattgaattcgccgtttccaaattgtcttttcatttctttcttttgttctgcaattagacattgctagggttctggagtactggattagctcattaaggattgagtactccatctatcttctgtcttcatggataaagacaaatctctaggtttgccacctccgtctggacgttattctggttactcgtccaccggaagtgttttcaacgtgaaatctgaaccgtccccgtcgtcgtcaaccacgttgtatccgccattggctccgggaactaccagttccgagtctagccattttggacatggattgtccacggattctagtggttttagtcatgatattagcagaatgcctgataatcccccgagaaatagaggtcataggcgtgctcattcggagattctcactttaccggatgatattagtttcgacagtgaccttggtgttgttggaggtggtgatggtccttccttctccgatgatgccgaggaggacttgctgtccatgtaccttgatatggataagttcaattcatcgtcggcaacgtccacgtttcaaatggttgagccgtctaatgctgtgggagcatcggcttcaacaccggcgtcaggggcacccacctcttctaccgagaatgttgttattgggactaatgaaaggcccagagttagacaccagcatagtcaatccatggacggctcaaccaccatcaagcctgagatgctggtttcaggttcagaagacatgtctgcggctgattccaaaaaagcaatgtcagctgccaagcttgctgaacttgccttgattgaccccaaacgtgcaaaaaggatatgggcaaataggcagtctgctgcaaggtcaaaagagagaaagatgcgatacattgctgagcttgaaaggaaggtgcaaacattgcaaacggaagcaacatctttgtctgcacaattaactctcttgcagagagatacaaatggcttaaattctgagaacaatgaactgaagctgcggttgcaaaccatggagcaacaagttcacttgcaagatgcattaaacgatgcattaaaagaggaaattcagcatttgaaaatattgactgggcaagctatgccacctaatggaggacctatgatgaactttgcttcttttggaggggggcagcaattctatcccaataatcatgccatgcacacccttttagctgcacaacagtttcaacagcttcaaattcaccctcaaaagcagcagcagcatcagtttcagcagcttcagcaacagcagcgggaacagcaccaacaatcaattgacttgaaaatgagagaagctacacctactccatgccccaaagacaatgcctcatcagatgtaaatccttctggggccaaggactgttgagagttgagactgctcattgtcttctctatttgctttatagattttcctttgtcttgtgtcctagtgtgtttagcctttgttatattttttcattcttaaacagtacaaatggtcctagttagagattgagtataatacatttgcatctttgttattatgt

SEQ ID NO: 7809 - DNA, 1520 bp, Glycine max
gcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7810 - DNA, 1469 bp, Glycine max
tatatatactatgatgagagtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgtttggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctctacctatcttctatctactacgaataaataaatccagcatacgatgcttgtgttttgt

SEQ ID NO: 7811 - DNA, 1457 bp, Glycine max
gatgagagtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgtttggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctctacctatcttctatctactacgaataaataaatccagcatacgatgcttgtgttttgt

SEQ ID NO: 7812 - DNA, 1457 bp, Glycine max; identical to SEQ ID NO: 7811

SEQ ID NO: 7813 - DNA, 581 bp, Glycine max
ggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctctacctatcttctatctactacgaataaataaatccagcatacgatgcttgtgttt

SEQ ID NO: 7814 - DNA, 585 bp, Glycine max
aggccatagtgatactagtgattaatgaaggagatgcaaacattgaacttgttggcattaaagaacaacaacagaagcagaaacaggaagaggaacccttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgt

SEQ ID NO: 7815 - DNA, 1991 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtt

SEQ ID NO: 7816 - DNA, 2027 bp, Glycine max
gtacaccgtattaaagaatttaagatatactatgatgagagcgcggttcccattactgttgctgggagttgttttcctggcatcagtttctgtctcatttggcattgcgtattgggaaaagcagaaccccagtcacaacaagtgcctccgaagttgcaatagcgagaaagactcctacaggaaccaagcatgccacgctcgttgcaacctccttaaggtggaggaagaagaagaatgcgaagaaggtcaaattccacgaccacgaccacaacacccggagagggaacgtcagcaacacggtgagaaggaggaagacgaaggtgagcagccacgtccattcccattcccacgcccacgccaacctcatcaagaggaagagcacgagcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7817 - DNA, 1960 bp, Glycine max
aatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtg

SEQ ID NO: 7818 - DNA, 1992 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtcc

SEQ ID NO: 7819 - DNA, 1992 bp, Glycine max
agttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtt

SEQ ID NO: 7820 - DNA, 1458 bp, Glycine max
ctatgatgagagtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgtttggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctctacctatcttctatctactacgaataaataaatccagcatacgatgcttgtgttt

SEQ ID NO: 7821 - DNA, 1980 bp, Glycine max
atatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttt

SEQ ID NO: 7822 - DNA, 1977 bp, Glycine max
accttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgttcac

SEQ ID NO: 7823 - DNA, 1990 bp, Glycine max
ttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtc

SEQ ID NO: 7824 - DNA, 1226 bp, Glycine max
tctcactcttcttgcagcatctctctccattaccttcataactcaatctcccattattattagagatgacggttgaaaaggaagatttgggtttgagtctaagcttgagcttccctcagaaccccccaactcatcttcatctcaatctcgtttcctcttctccttccagccacaaccctcagaaaccctcttggaacgaccctttcacttcttcagctggatcatcattccttcgaggaatcgatgtgaaccgtttaccttctgtggtcgattgcgaagaggaagcaggtgtgtcatctccaaacagcacggtttctagtgtcagtggaaaacgtagcgagagggaagaagccaatggtgaagaaaacgacacagacagagcttgttccagaggcatcatcagcgacgaagaagatgccgaaacctctagaaagaaacttagactctccaaagaccaatcaattatcctcgaagagagcttcaaagaacacaacactctcaaccccaaacaaaagttggcgctggcgaaacagctgggtcttcgagcgagacaagtggaggtgtggttccagaacagaagggcaaggaccaagctgaagcaaacggaagttgactgtgagtttttgaaaaggtgctgcgagaatctgaccgtggagaacaggaggttgcagaaggaagtgcaagagcttagagcactgaaactttccccgcagttctacatgcacatgaccccacccaccactctcaccatgtgcccctcgtgtgagcgtgtcgcggttcccccctcctccgccgttgatcctgccatgcgtcaccatcacgtgcctcctacacaacctcgggccttccccattggcccatgggccaccgctgccgccactatcccgcacaggcccttcgatgccctccgtcgcagatcttgactcgtcgaaacaaaatgacaaaatttgaaaaaaagaaaacggttgtaatagtaggaagccatgaattatgtgttcaaagtgtggtctaagatatggtggttaggaaaactgattttgtgggtctctaatgttttgtactagtttgacccttcgtctttgttttgggtttcggagcatgacctggtttagttagttagaggtttttttagtttgtaatacttactgcgttactctcatttctcatgattaaatcggagattctgtaaagttcagtagtcttaataaatattatatattacatat

SEQ ID NO: 7825 - DNA, 1487 bp, Glycine max
aggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7826 - DNA, 1992 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgttc

SEQ ID NO: 7827 - DNA, 1966 bp, Glycine max
aaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtc

SEQ ID NO: 7828 - DNA, 1644 bp, Glycine max
agcagaaggaggaacacgaatggcatcgcaaggaggaaaaacacggaggaaagggaagtgaagaggaacaagatgaacgtgaacacccacgcccacaccaacctcatcaaaaggaagaggaaaagcacgaatggcaacacaagcaggaaaagcaccaaggaaaggaaagtgaagaagaagaagaagaccaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgt

SEQ ID NO: 7829 - DNA, 1739 bp, Glycine max
ctttaaaattctctatcgaccaaagatcttcaacaaaccggttaagtttgtgtagtttggtaagatgggtggtggatttagagtgcttcacttagttagaccatttctctcgtttcttcctgaagttcagactgctgacaggaaagtgccatttagagagaaggtcatatatactgtgatctctttgttcattttccttgtttgcagtcagcttcctctgtatggcatacactcaacaacaggtgctgatccattctattggatgcgtgttatccttgcttcaaaccgtggaactgttatggagctgggaatcacccccattgtgacttctgggctggtaatgcaacttttggctggatcgaagatcattgaagtggacaacaatgtaagggaggatcgtgctctcttaaatggtgcacagaagctacttggcattttgatagctgttggtgaggcagttgcatatgttctttctggaatgtatggtagtgtgggtcaacttggagtgggaaatgccatcctcatcatcctccagctatgttttgcgggtattattgtgatatgtttggatgagctccttcaaaaaggctatggcttgggatctggaatttctctgttcattgccactaatatatgtgaaaacatcatatggaaagcatttagtcccaccaccattaacagtggacgtggagctgaatttgaaggtgctgtcattgctctattccatttgttgataactagaacagacaaggttcgtgcccttcgtgaagcattttaccggcaaaaccttcccaatgtgacaaatctgcttgctaccatcttgatcttcctaattgtgatatacttccaaggatttcgtgtggttttgcctgtgagatcaaagaatgcccgtggacagcaggggtcttatccaatcaagttattttatacctccaacatgcccattattcttcagtctgcccttgtttccaatctctacttcatttctcagcttctacacagaaagtacagtggaaacttcattgtagatctattgggcaaatggaaggagtctgaatatggaggtggtcagtctgttcctgttggtggtattgcatactacatcactgcaccttccagcttagctgatatggcagccaatcctttccatgcattattctaccttgtgtttatgttgtcagcctgtgccttgttctctaaaacttggattgaagtctctggttcatctgctagagatgttgcaaagcagctgaaggaacaacaaatggtaatgcctggacatcgggaatcaaacttgcagaaagaactgaaccgatacattcccaccgcggcagcatttggaggcatatgtatcggtgcattgactgtgttggcagatttcatgggggcaattggttcagggacaggaatattgcttgcagtaacaatcatctatcagtacttcgaaacatttgagaaggagagagcaagcgagcttggcttcttcggtttctaagctctgcttagcacattcactgttggtgacgcaattcggctctaccgcacccacagttttgttgtgtaatgaggactggttggtaggttgtttaacacagtaaggaagaacttagattagttttgtatcacttttctcaaccgaggaagccctagtataatatcactgtaaacgttatggagtttctctgaatacacttgcgttaatttaagttgtcagttctagaaattacttgctatttaat

SEQ ID NO: 7830 - DNA, 2095 bp, Glycine max
atttcaccaatttctattttcataactttctctgcagtctcttcacctttatgttaatgatattatgtgtttagagagaaagagaacaagcatagttgagcttgattgtgttcttcaacattagaacaagaaaagaaagacaacaacatggaaggaggaggagtagaagttgatgcctctgctttcagagaatgcttgtctctgtcatggaaaaatccttacgttcttcgccttgctttttctgctggaattggtggccttctctttggctatgacactggagtcatatctggggctattttatatatcagagatgatttcaaagcagtggataggaagacttggcttcaggaagccatagtgagtatggctcttgctggagcaatcgtaggagctgcagttggtgggtggattaacgatcgatttggaaggagaaaagctattcttcttgcagacacactcttctttattggctctgctgtcatggctgccgctaccaatccatctattctcattgttggtcgagttttcgttggccttggtgttggaatggcctcaatggcatctcccttatacatctctgaagcttctccaactagagttcgaggtgctttagttagtctcaatggctttctcataactggaggacaattcctctcctacctcatcaacttggccttcacaaaagcaccaggaacatggagatggatgttaggagcagcagtagtaccagccctgatacaaatcgtattaatgatgatgctgccagaatcaccgcgttggctgttccgaaagggaagagaagaagagggtaaagaaattctaaggaagatttatccaccccaggaagttgaagcagaaattaatactttgagggaatcagttgaaatagaaatcaaggaagcagaggccacagataacatcagcatagtcaaaatgctgaaaactaaaactgtgagaagaggtttgtatgcaggaatgggccttcaaattttccaacagtttgtggggatcaacactgtgatgtactacagtcctaccatagttcagttagctggttttgcatccaaccgaacagcacttcttctgtcactagtcacatctggtctcaatgcatttggttctattttgagtatatacttcatagacagaacagggaggaaaaagcttgtgttgttcagtttgtgtggtgttgtgttctcccttgttgttctaaccgttgtgttccatcagagtacaactcactccccaatggttagtgcactcgaaacctctcacttcaataacacttgcccggattaccattcagctgcgaaccctggtggatgggattgcatgaagtgcctgaaggcttctccaaattgtggcttctgtgcttctggagccaataagctcttacctggggcatgtttgatctccaatgacaccacaaaagatcagtgccatgaagaagatagactatggtacaccgtggggtgtcctagtaaatttggatggcttgcaatagtagggcttgcactctacatcatattcttctcacctgggatgggaactgtgccatgggttgtcaactctgagatttatcccctaagatatcgaggaatatgtggaggaatggcatccacatccaattgggtctcaaatcttattgttgctcagtccttcctatcattgacacaagctattgggacctcatggacatttatgatatttatattcatcaccatagctgccattatctttgttattattttcgtgcccgaaaccaaaggacttccaatggaagaagtggagaagatgttggaaggaagagatctcaacttcaagttttggcagagaagttctcactgtggagaagaagtaccaccacaaaagactcaatcaaattaagtctattgtgttgcatcatttgtaatattggagtattaactaaagaagtataggtaataaaatcgtagaatgtagctattagattctaagtatatacaataaaatcgtagaatgtagctattagattctaagtatatacaatatcttgtttgtgtgaatttttttcttatcaacaaatattattttgttaattttgttacaaatt

SEQ ID NO: 7831 - DNA, 1543 bp, Glycine max
gatggatcctccaccgaagagctggagcatccacacccgatccgagatcatcgcaaaatacgaggtcatggagcgggtcgggtcgggagcctacgccgacgtctaccgtggccgtcgcctctccgacggcctcaccgtggccctcaaggaaatccacgactaccagtccgccttccgagaaatcgacgcgttgcagctcctcgagggctccccaaacgtcgtggttttgcacgagtacttctggcgcgaagacgaggacgccgtcctcgtccttgagttcctcagaaccgacttggccaccgtcatcgccgacaccgccaaggccaaccagcccctccccgccggcgagctcaagtgctggatgatccagattctctccggcctcgacgcctgtcaccgccacatggtcctccaccgagatttgaagccctctaatctcttaatttccgaacacggcctcctcaagatcgctgattttggacaggcaagaattctcatggagcctggtattgatgcttctaataatcatgaagaatattctagagttttagatgacattgacaataaggatactattactagcacccacgatgggaatgcaacatgcaacacaagtgacgtagatagggaagaggaagaacttggttgttttacgtcatgcgttgggactcgttggtttagggctcctgagttgctttatggatcaagaaactatggtttagaggttgatttgtggtccttgggatgtatctttgcagagcttttaacgctgcaacctttgtttcctggaactgctgatattgaccagcttagtagaatcattggtgttttgggtaaccttgatgagaatgcttgggctgcttgttctaaacttcctgattatgggataatctcctttagcaaggtggagaaccctgctggtcttgaagcttgtttgcccaatcggtcccctgatgaagtggctctggtgaaaaaactggtttgttatgatcctgccaagagggccacggcgatggagctgcttcatgacaagtactttagtgatgagcctcttcctgttctggtttctgagctgcgagttcctctgaccagaaaagagcaagatggggattcccctggtgggtggggtgatatcaacgatatggattccgattccgattcccagtttgatgagtttggccctctgaatatcacaaggactggtactggtttctccatacagtttccttgaagaattcaaggtacattgtattcttggaactgcctttttgccttttctgtcgtgttgctcaactgttactatttgctggaaattcttcggtgagaatattgataagaaaaatccctttttttttttctgatttgtcattcacttgtgaacaaagggataaattattcaaaagtaattagaatgattgtgtgtttacatgacattcatagttgaccatgacactcacagttgatagtttatataatacatggacttgtatccttccaaattcacacatataatgatagcacgtactatagttatttttgtgtt

SEQ ID NO: 7832 - DNA, 1666 bp, Glycine max
cactatttaccccattttctctaaatccaaacaggccccaaaagaaagagagggaaaattctcttccatggcctcttcacgccctgccaatgtgggaatccttgccatggacatctacttccctcccacctgcgtcacccaggatgctttggagggtcatgatggggtgagcaaagggaaatatactattgggcttggacaggattgcatggccttctgctctgaggttgaagatgttatctcaatgagcttgacggtagttacttcacttcttgaaaaatttaatgttgatccaaagcaaattggacatttggcggttgggagtgaaactgttattgacaaaagcaaatcaattaagaccttcctgatgcaagtttttgaggcaagtggtaatactgacattgaaggtgttgattcaactaatgcatgctatggaggaacggctgctttgttcaactgtgtgaattgggtggagagtagctcatgggatggacgttatggacttgttgtttgtacagacactgcggtatatgctgaaggacctgctcgtcccactggaggagctgctgcaattgccatgcttgtagggccagatgctcctattgcttttgaaagcaaactcagaggcagtcacatgtctcatgcatatgatttttacaagccaaaccttgctagcgaatatccaattgttgatggaaaactctcacagacctgttatctcatggcacttgattcctgttaccggctttactgtgagaaatttgaaaaattggaggggaggcctttttcaatgtcagattctgattattttgtgtttcattctccatataacaagcttgtgcagaaaagttttggccgactatacttcaatgacttcttgagaaatgccagttttgttgatgaagttgccagggaaacccttgcaccatatgcatccttatctggtgatgagagttatcaaagtcgtgatcttgaaaaggcaaaccagcaagctgcaaaacatctatatgatgcaaaggtgcagcccagcacactaatcccaaagcaagttggtaacatgtacactgcatctctttatgcagcatttgcatctcttcttcacaataagaacagttcgttggtaggtaaacgggtagttatgttttcatatggaagtggtttaacagctacaatgttctccttccagcttcaagagggtcaacatccgtttaacttgtcaaacattgtaacagtgatgaatgtttcggacaagttgaagcagagagttgagattcctcctgaaaagttcgttgaaacattgaagatcatggaacaccgttatgggggtaaggactttgtgacaagcaaggactgtagctacttaactccaggcaccttctatctcaccaatgttgattccatgtacaggagattttatgccaagaaggactaggttattggttagttgatgatcgctgatatattcaaatatggagttaaaatgtattttcttatggttcacctgtatttgatcccataaggttgtgtatcaaaatgtttataagatgtttcatttttttgtggtgatcaggttgtaaccaaaataagaataagtttatttgcgaattggcaattgtttttaaatgcactaataatccaaatatattagtagtttcttcttgagtgc

SEQ ID NO: 7833 - DNA, 1335 bp, Glycine max
agcgaaaaaaatacttatttgattttttctacaaaattttcttgagccagcaagagtcacacatcataagaccgtgatctttaagcaggacaaaacaaaatctatcaaggaagccatatattggtatccaaattccaaacttgtgttgggtttggttccttgagttgagaggagtgaaaaaatggatcacagtgcggatgctcaacgcacggacctgatgaccatcacccgtttcgtgctgaacgaacagtcgaagcacccagagtctcgtggcgatttctcaatcctgctcagtcacattgttctcggctgcaagttcgtctgctctgctgttaacaaggcgggtcttgctaagcttattggacttgcaggagagacaaatgttcagggtgaagagcaaaagaaattggatgtcctatccaatgatgtcttcatcaaggcattgatcagcagtggacgaacatgcatcttggtgtctgaagaagatgaggaagcaacatttgtggaaccttctaagcgtggaaaatactgtgttgtttttgacccgctggatggttcctctaacattgattgtggtgtttcaattggcacaatctttgggatttatttgataaaagaagaccatgaaccaaccgtagaagatgttttgcaacctgggaagaacatgttggcagctggttattgcatgtatggaagctcttgcacgcttgtgttaagcactggaagtggtgttaatggtttcacccttgatccatctcttggggagttcattctaactcaccctgacatcaagatcccaaagaaaggcaagatctattcagtgaatgaaggaaatgctaaaaactgggatggccctactaccatgtatgtggaaaactgcaagtatccaaaagatggttcatcaccaaagtccctaagatatattggaagcatggttgctgatgttcaccgcacattgctttatggaggtatctttctgtacccggctgataaaaagagtccaaatgggaaacttcgtgtactctatgaagtcttcccaatgtcattcttgatggaacaagcaggaggacaggctttcaccggcaaccaaagggcacttgatttggttccaaagaagttgcacgagcgatctcccatattccttggtagctatgaagatgtagaggaaatcaaggctctttactctgctgatgaaaaataggaatgaagctggaagaaagctatctttgtctttcgctactcacaagcaattgttatctaattgttacacatgtcatgtatatgttaagaaaagttattaatgttttgtgatttagaaaaattattttattcctt

SEQ ID NO: 7834 - DNA, 1996 bp, Glycine max
tgagctttcacttcttccaacttcttcatctatctacttctcttctcttctcttcccttcttctgttgtaaccaacaacaaataacacttttatccctcagaaattaaccatttttcgtttctgggttttctataattttgttgattttccattccttctattttctgctgctgctaggtagcagtggtatgtctagcttatgagttatgagctatgagcatctttctattttgaagagaagattggaatttttttctctttagagaaaggcttcttcctagtggttggatttttatccatcaagttattgattgaggagggggtgatcacgcgatcttgtagatgatggagagggtttgtttttgtgctttgtgattctgagatgtagtggttggtgaagtgaagaatcaaaggcagagtttgtacgataaatttgacttttggatcgaggtgggtccatttttgtacacaattttgttgtttgattctgtttcgagctctctaaggggagagagaggtgggaggaaggtggaacatgtgattttgcttgtttgtgttgtacttttcgtatttcggaattcgcattccagaaaagaggagctttagttcttaggtgttgtgatctgattgtaaggagggaaacaaagttgagcaagtttgaaactgtaagaagaggaaggagaagatcttgattcttgacaagagattgtttcttctgcagctatggcgattcaagatcaaaatggatttttcagatcacagggtggtcctccagaagaaggtggtgtatctttgagttctgggcattctgtcacacatattcaacttaatgaccagttttcttgtgggaatgactatgctctgaaggtaaggaagccgtatactatcactaaacagagagagcgatggacagatgaagaacataagaagttccttgaagctttaaagctgtatggacgggcttggcgacgtattgaagaacatgttggcacaaagactgctgttcagattcgaagtcatgctcagaagtttttttctaaggttcttcacgatcctactgggaacaatacaaacacagtggagtcaattgaaattcctcctccaagaccgaaacgaaagccgatgcatccttaccctcgtaaactagttgagaccccaaataaggaaatttcgatcccagaacaacctatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtttgtgccatataaaagatgcatatctgttgtgacagctgatgatagagaagagcaatgtatccatctttccttgtagcttataccccactggatttttccttcaaaaagtgttccctttgtcatgatgagctgtaatggttgttttggttgctgctggatgtgagttggtatgatataggaaggaaaaaggggtggctgaaaattttgatatttccgttgaattgcactgcactgcacattctccagctgttcaaatccgt

SEQ ID NO: 7835 - DNA, 1789 bp, Glycine max
aacgtatagaaaaagcttctccaaagaatttgaaggagaaagattcattcatgttcattttttccttttccccttcgtccccatcaagtttctgattctctcttttcacttcctttctctttcttcattcttctttctcttttcaactattttctttacatttttttctttttctctcgcttttttcgcgttcactttctctactctgttttacgcattttatttattgttttgttagttaattttgcgattcgagtaattggtatgcttgtgttttctagaagacgatattttcacgacgattaagctgcgttttcgccggtgtcgttttaccgcaagatggtgtcgttttcggaaatatgcaaaaagggttgaagttctttcttcagcattgaatctttgattacataggttggtttctttggaactcaattcaattcaataattggtcctccctttttgtggaactcaattcaattaggttagtggaaaaaatatggttgaatcaattgctgcaacttcactccttggccaccgcccaatttgtggtggaagtttaaccagggatgtttctgctaaacgcaaatctttgaatactgttcggttcccaacaactgagtttcttggtgggggaaggattgtggtttctctggctttgcctaaatctgataagcaggataggtttgtgttttcatcaattaaggccttggctgtggagttaacaagagaagcacatgcttatagggaaaagaaattgcccaatagggataacaagattgaccgtggatttgatcagaggcctgatttgtggcctccggcgaatagggcggataagctgtcacttcggaatcccttgctccggcatgagaggatgggatgtggttggttgggtgctatatttgagtgggagggtgttctaattgaagacaaccccgatttagagaagcaggcttggctggcactctctcaggaagaaggcaaaccctctcctcctgcttttatcctcaagagaatagaaggcatgaagaatgaacaggcgatttcggaagtgctgtgttggtctagggatccggcacagctgagaagaatggctaatagaaaggaagaaatctaccaagctttgctgggtgggatatatagtttcttgtctgggtccaaggagtttgtgagtgttttgatgcattataagataccaatggcattggtttccacgcggcctagaaaggctcttgagtctgctatgggggagattgggattgaggacactttcagtgttattgtagcagcagaggatgttcataggggaaagcctgatccagaaatgtttgtgtatgctgcacagcttttgaacttcatacctgagagggtcattgtgtttggtaactccaatctaacagtggaggctgctcatgaagcccggatgaagtgtgtggctgttgctagcaggcatcctgtatatgagcttggggctgcagacttggttgtcaggcgccttgacgagctttcagtggttgatttgaagaatcttgcagacattgaaatgactgaatttgggtctgtggagcctgagatggagctggaggtggaaaaagatcatgatacatcatcacttgatgacaatttctggtaaatcctataaatgtacagttgattgaactcatctgattgttgatgatattagttacaggttagttacttgtgtatatggtaaacagaataaatggggaaaaaatgataagtggtatgcattgaacattgatgttactactaatgaattttctgttccttt

SEQ ID NO: 7836 - DNA, 1541 bp, Glycine max
gctttctgcaccctcttcctcttaggttcccatatttttctctcttgtcgtggacctcaactttgtaggctcgccttagaaaaaaccttcttttctttttggtgggggtgagagttgctatcttattcctggtttcatcaacaagacactaacatctttgttgtttttagtttcagaattccttatactcacacaccaaaattctggtacaccatgatttttccaagattttgtacgaatctaaaaggtatggcttttatagattctcaagtttatcttgatcacacaggtaaaagattctgaaaatctgtgcaccttgtgaatcaaagctctataatttcttcctttccgtgtatctcttctgtgttttttgtgagcagccttttctagttcctctccatttccatctctttaggaacttaattcaactaagattttttgtgtgcttgtggcttgaggtatggaattggaaaccctctacaccccttgttatatgccaaactcaaattggtttgtgcaagagagcctcagcacagagtggactagagaagataacaagaagtttgaaagtgcccttgctatatatgacaaggacaccccagatagatggttcaaggtggccgctatgatccctgggaagactgtgtttgatgtgatcaagcaatatagggaactggaagaagatgtgagtgaaatcgaagcagggcatgttccgattcccggctaccttgcatcttctttcacctttgagctggttgacaaccacaactatgatggatgcagaagaaggcttgcacctgtcagaggctctgatcaagagagaaagaaaggagtcccatggactgaagaggaacacagacgttttctgatgggacttttgaagtatggtaaaggagattggagaaatatctctcgcaattttgtggtcacaaagactccaacccaagttgctagccatgcacaaaagtactacataaggcaaaaggtttctggaggcaaagataaaaggagacctagcatccatgatataaccactgttaatcttacagaaacttctgcatcagacaagaacaagcctcctgtgattgcaccacagcagaagctgaatagcatgtcaaaagtacagctggactggactagtagccactacaatgatggatcactcatggttttcaacccaaatagtgatgacttgtttgtgtcatcttcatctgatgtcacttccatggccctgaaaatgcaagggcaagatctctatgaatgtgccttacgtgaggcttatgccaaggtaaaagttccaggtttcagcatggctcctagagacttcaataatgaagctgtttttggtattcatgcactgtaattccaaccctgatgatgttaaagaaaaaattatagatcattgttctgtaggattaatgtagatgacctgaagctagcaagctacttcgttcatcattagtgaacatcctaaaagaaaactagactaatgtttcaatccttaaaaactgaatttggaatggacttcttttaaagttttc

SEQ ID NO: 7837 - DNA, 1799 bp, Glycine max
cttattatgaacctctctctatgcaattcttcaaaccttaacacctcaagaaaaccattgatggcactccctcactccatctctgccttagccaccacactcacactctcctcgccaacaaccaaaccccagaaagttaacccctttccctttttctcgaaccaaaagacacgatttttaacgaaacaaacgcgacccagaagcagaagaagcctctccctaacccctgcacgcgttgcggcgccaccctcaactgttgaagccgatcaatcatacccggagaccgaaaataacgaaactgaggaagagtttaacgatgaaagctcttattctaaattcacttggagggatcactggtaccctgtttcgttgatcgaagatctgaaccctctcttgcccacaccgtttcagcttctgggtcgtgaaatcgtgctctggtacgacaagtccatttcccaatgggttgcttttgatgacaaatgcccccatcgtcttgcccctttgtctgaagggaggattgatgaagatgggaagttgcagtgttcttatcatgggtggtcttttgatgggtgtggatcttgtgttaagatacctcaggctgcatctgaaggccccgaagcacgtgctattggatctcctaaagcgtgtgccactaggttccctaccatggtgtctcagggcttgctcttcgtttggcctgatgagaatggttgggagaaagcaaaggcctccaagcctccaatgttgcctgatgactttgacaaaccggagtttgccacggtcaacattcagcgtgatctgttctatggttacgatactctcatggagaatgtctctgatccttctcacattgagtttgctcatcacaaggtcacaggaaggagagacagagccaagcctctgccattcaagatggattctcgtggttcatggggcttctctggagctaatgaagggaacccacagatcagtgccaagtttgttgcaccatgttatatgatgaacaagattcagattgataccaaactccctgtagttggtgaccagaaatgggtagtatggatatgttccttcaatgtccccatggcacccggtaagactcgctccatagtttgcagtgctcgaaacttcttccagttctcagtgccagggccagcctggtggcaagtcgttcctagatggtatgagcattggacttcaaacaaggtatatgatggagacatgattgttcttcaaggccaagagaaaatcttcctttcagaaaccaaggaaggtggagacattaacaaacagtatacaaacatcaccttcacaccaacacaggcagatcgctttgtcttggcatttcgaaactggctaaggcggcatggcaatggccaaccagaatggtttggcaacagcagcgaccaaccattgccatcaactgttttatcaaaacgtcagatgttggatagatttgaacagcacactctcaagtgttcatcatgtaaagcagcatatgagggattccaaacatggcagaaagtcctaattggtacaacagttgtgttttgtgcaacatcagggatcccatcagatgtccagttgcgtgtacttttggctggactcgcaattgtcagtgcagccataacttttgccctaaatcaactccaaaagaattttgaattcgtggattacgtgcatgccgaaattgattaaacacttccctccaaaggaacttctactagttagttgtaaatagagttgaagacaaaaatacatgtatactagtattttgatgaaagagctcaaatcttcct

SEQ ID NO: 7838 - DNA, 1889 bp, Zea mays
cacgccgtcgctagcgcctgcggcctgccgcggcgaagcttctgccctccccggcgccgggctcgggtcgtcgtcggccaggaagatggctggcggcttcagggtactgcatctggtcaggccttttctggctttcttgccagaggtgcagagcgcggataggaagataccgttcagagaaaaagttatatacactgttatttccctcttcattttcctggtctgcagccagctcccactctatggcattcattcaacaactggagctgatcctttctactggatgcgtgttatcctcgcatcaaaccgtggcactgtgatggagttgggtattactccaattgtgacatctgggatggtaatgcaacttcttgttggatcgaagatcattgaagttgacaacagtgtgagagaggatcgtgctctgctgaatggtgcacaaaagttgcttggtatcctgattgctattggggaagctgtggcatatgtcctgtctggaatgtatggcagtgtaagccaacttggaacagggaatgctatcctcattatacttcagcttttctttgctggcatcattgtcatctgtctggatgaacttctccagaaaggttatggcttgggatctggcatttctctgttcattgctaccaatatatgcgagaatatcatctggaaggcatttagccccacaaccatcaacagtggtcgtggtgctgaatttgaaggggctgtcattgcactgtttcatctgttgattacgagaaccgataaagtccgtgctcttcgtgaggctttctaccgccagaaccttccaaatgtgaccaatttgcttgccacagtcttggtcttcctcatagttatctatttccaaggcttccgtgttgtgcttccagtgagatcaaagaatgctcgtggccagcaaggctcatatccaattaagctattctacacttcaaacatgcccatcattctgcactctgcactgattaccaacctctatttcatatcccagcttctctacaggaagtacagtggaaacttccttgttaaccttcttgggatgtggaaggagtctgaatactctggccattctgttcctgttggtggtcttgcttactatgtaactgccccatcaagtttggctgatgtccttgcaaatccattccatgcactgttttatgtggtcttcatgctgtcagcttgcgctctgttctcaaaaacgtggattgaagtttctggttcatcagcaaaggatgttgctaagcagctcaaggaacaacaaatggtgatgccaggacatcgtgagtcaaacttgcagaaggaactgaaccgatacatccccactgctgctgcatttggtggagtatgcatcggcgcattgactgtcctggctgatttcatgggtgcaattggttcaggaactggaatactgctggctgtgacaatcatatatcaatacttcgaaaccttcgagaaggaaagggcaacagagcttggtttctttggtttttgattagtagctgtggaaccttgaaccgatagctgaattttcttgtaaggccctgtttggaagcaacccggttttttagaaaccagtttttatattttagctaggagaggccagcttcttggtttttaagaaactgagaatctaatttctataaacttagtcataaactagtatgtttggaaccacctcaatttctataaaccagtttcttaaaaactgggtgtttccaaacagggcctaagtcactgtagtgcttagccagttgtaacttaagagagttctgttaggttgccttgtggccacaatcatgtagcagaatctgtccaaagagcgtgctcatcccatccacaatcagtaatccgcactctacagtttgctc

SEQ ID NO: 7839 - DNA, 1851 bp, Zea mays
cgattttgatcttgcagccacctttttttgttctgttgtgtatctagtagttggaggagatatgcagtttgcacttgcattggacacgaactcaggtcctcaccagataagatcttgtgagggtgatgggattgacaggttggaaaaattaagtattgggggcagaaagcaggagaaagctttgagaaataggtgctttggtggtagagttgctgcaactacacaatgtattcttacctcagatgcttgtcctgaaactcttcattctcaaacacagtcctctaggaaaaattatgctgatgcaaaccgtgtatctgctatcattttgggcggaggcactggatctcagctctttcctctgacaagcacaagagctacgcctgctgtacctgttggaggatgttacaggcttattgatatccctatgagtaactgcttcaacagtggtataaataagatatttgtgatgagtcagttcaattctacttcgcttaaccgccatattcatcgtacataccttgaaggcgggatcaactttgctgatggatctgtacaggtattagcggctacacaaatgcctgaagagccagctggatggttccagggtacagcagactctatcagaaaatttatctgggtactcgaggattattacagtcacaaatccattgacaacattgtaatcttgagtggcgatcagctttatcggatgaattacatggaacttgtgcagaaacatgtcgaggacgatgctgatatcactatatcatgtgctcctgttgatgagagccgagcttctaaaaatgggctagtgaagattgatcatactggacgtgtacttcaattctttgaaaaaccaaagggtgctgatttgaattctatgagagttgagaccaacttcctgagctatgctatagatgatgcacagaaatatccataccttgcatcaatgggcatttatgtcttcaagaaagatgcacttttagaccttctcaagtcaaaatatactcaattacatgactttggatctgaaatcctcccaagagctgtactagatcatagtgtgcaggcatgcatttttacgggctattgggaggatgttggaacaatcaaatcattctttgatgcaaacttggccctcactgagcagccttccaagtttgatttttacgatccaaaaacacctttcttcactgcaccccgatgcttgcctccgacgcaattggacaagtgcaagatgaaatatgcatttatctcagatggttgcttactgagagaatgcaacatcgagcattctgtgattggagtctgctcacgtgtcagctctggatgtgaactcaaggactccgtgatgatgggagcggacatctatgaaactgaagaagaagcttcaaagctactgttagctgggaaggtcccagttggaataggaaggaacacaaagataaggaactgtatcattgacatgaatgctaggattgggaagaacgtggtgatcacaaacagtaagggcatccaagaggctgatcacccggaagaagggtactacataaggtctggaatcgtggtgatcctgaagaatgcaaccatcaacgatgggtctgtcatatagatcggctgcgtttgcgtctacaaaacaagaacctacaatggtattgcatcgatggatcgtgtaaccttggtatggtaagagccgcttgacaggaagtcgagcgttcgggcgcaagatgcgtagtctggcatgctgttccttgaccatttgtgctgctagtatgtactgttataagctgccctagaagttgcagcaaacctttttatgaacctttgtatttccattacctgctttggatc

SEQ ID NO: 7840 - DNA, 884 bp, Zea mays
caaaaccagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaagggtaatctagcgtccatgttttgattcaaacttccattatgttccgaaacagccttaaatttctccatttaaagactaaagatgtggctttagacggaaattcaacagtttgtgctcaaatgagttgtcgcttttcctaaatctgttgataaaattcagattttggcgcacacctgccaagttttttgtaatctgattacgggttgtaaacatgccgtgcttgataacctgccaactcgaaatgcagccttgaagcttgtcaacgtggagaggtcgtttgccgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggtttcccgagggccttgctgattggcagagcagccagcacccctggatctacgagaagtaaacagtgaaagtttcacatgaaaccttgagagctagaggaagcatgtcaccatttgtgctttagcaaagttttcgaaaagattatgatctgtatcttggaaccttatttccatggaccaaatttatttctttgccatgct

SEQ ID NO: 7841 - DNA, 1755 bp, Zea mays
ggcagaggtgcgcttccccgtgagccgggcaactggtgggtgtcgtcctcctctttgcgcagcagagtaatggattaatgctttaagcaaggtaatgaaatgtaccagaagtgacttatggaaaggaaggagcttgttcactgttctgaatgaggaagtttaatctgatgcagtctcaaaagagcagagttttgggagcaatgtcatcctctttgcctattctgccaaatcctttgaaagggagcttcccaaggcctcataacccccagcatattcctatgttgaggcagcttcctgatgactctatgcccttgtgtattgacacacatcagtctgttagtttgcacccaagagctggtgttatcggggtaccatattcaggctacactgctagtccacttgattctgtgtctaaccttgatagccagacaatggctgcaccctttatttctcagtcatccaattttgaagctctccagtctctatctgataataccccagaaacacacactaaggcagcctggttcacatcttctatggatgtttcaccactcaacacagataatattgctgcttctgatgttaatcaaatccatagtatacgtcctgctatgacatctgatgagagtgctacacaaaatgattggtgggcagatataatgaatgatgattggaaagatattcttgacgcaacagctactgattcccactcaaaagccatgattcaaatttccaactcagctacatcactacctgcagtaaatcagtcagcttcatctcatagtagggagatttgtcctgttgctagtcctcccaatagcagcaatgcttcagttgccaaacaacggatgagatggaccccagaactccatgaatgttttgtagatgctgtaaatcagcttggcggtagcgaaaaagctactcctaagggtgtgctaaagcttatgaaagttgatggtttgactatatatcatgtcaaaagccacctgcagaagtaccgcacagcccgctataaaccagacctgtcagaaggtacatcggaaaaaaggacagccactgaagagctggtcctggacctgaaaacgagcatggatcttactgaagcgctgcgccttcagatggaagtccagaaacggcttcatgaacagcttgagattcagagaaaattgcagttgcggattgaagagcaaggaaagtatctgcagatgatgtttgaaaagcagagtcaatcgagcacggagaaagtccaggatccatcctcaagggatacaacagctaaaccgtcatctaatcagagccagtctacaaacaaggatagtggtgcaaccatggacccaaatggaacaggagacatcgcacggactgcagaactgggagaacgttcgtctgaactaggtgtaaaacagaaactcgtagagatcgaatctggtaccgaagtagccacaggcgacagatctaagatctaccaagagaagcggcgcaaactgcaagatagttaacatatcggttgcactattcagacatagctgttcaaaccgtttgcttggtgaaaaattggtaatctgtgtgtcgaattcgactattgatccgtaagtccattggtgagttgtaccgctcttcagttagccatatatatttataaaggatccaaaggaggaccaaaggagaacttcctggcagccgtgtttataacattagcaataagagctatccccgaagttatggggtaaaataaggtcttgaaatttagctttc

SEQ ID NO: 7842 - DNA, 1401 bp, Zea mays
cacgccgggacgggaggcacaggtgcggtctgcgtcgagagttggtccactggcaggccggaatgaagaagtgcgcgtcggagctggagctggaggcgttcatccgggagagcggcgaggacgcccgcgccgccgccggaggtagcagtccggggtgcggtggatcaagcgatcccggagggagcggcgtcttctcacccggcttcggtttcgccgactcggacaccatggatggaggcagttggtggtacgggaacgtccgcacgccgaacccagtcatgtcgcaggcggcgtccatatccgctagccccgggctaaccacctcagccaatcatgctcttgaaagcgagtcagactccgacagcgaatcactgtatgaggtagagggagttccatacgagcgaggtaacagatccattgagacgaagcgaataagaaggatggtgtccaatagggagtctgcgcggcggtctaggaggaggaaacaggcacagttgtctgaccttgagtcacaggttgaacgactcaaaggtgaaaacgcaacactgttccagcaactttcagatgccaaccaacagttcagtactgcagtcacagacaacagaatcctcaaatccgatgtagaagcgttaagaattaaggtaaagatggcagaggatatggtagcgagaagtgctgtatcgtgtggcctaggcgaccttggcctggcaccatacgtgaactcaaggaagatgtgccaagctttgaatgtgctcacagggttggatttactagggagtgatgcgttcaggggtccaaccgcaggtacacgagtacagaactcaccagtacagagcactgcaagcctagagagtctggataaccgaaagtccaacgaggtgaccagttgcgcggcggacatttggccttgagcttcaagccattgatctgattcaaagcttgctccaccctcaaaaaaaggaccagagtttgtcaactcaaatagctggtggcttgagcagagcttctggcacgagttctcttgaaccatatttccacataagctttataggatgcatcactcttttgatgtcacttagtttcaagtataaaatgaagctgtctttgtacaaagctgcaaatgagaagtaaatgaaacgtcctggacaaacttgtgaagtaggaatgatacataggctctatttccaggtcagatgagacagttatgtttacaacaaaaagcaatacatgttgtttagaaaccgctattaattcacaggaatgttcaatccagtacaagtcatctagtagatttgcacccctaccttctagtagattcaaccatgttttcactactacttgctgggactacaactgtacatcatgatggtaaaatgcataactagtgaggttcttgactcg

SEQ ID NO: 7843 - DNA, 1440 bp, Zea mays; identical to SEQ ID NO: 1457

SEQ ID NO: 7844 - DNA, 1006 bp, Zea mays
cgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacacagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgagggcgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggcggcggtggcgtcagcaacagcggcaccaagcgagcccgcccatcatagctgcgacttttagtgatgtaaactgcttagaaaaactgttgcggacatagcgcccatcatagctgcgactttttaaatggtgtaaacttttgtagtgcgactaggccgttgtcaccctatcatacttggcttcaagtaggttttttgtttttcagttttc

SEQ ID NO: 7845 - DNA, 1471 bp, Zea mays
ctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactacaagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaact

SEQ ID NO: 7846 - DNA, 826 bp, Zea mays
tgagaaccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaccccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaacccaacagtgttctaccaacaacccatcattggtggtgccctcttttagattgcttatgagttatagttcaataatgaagttttttggatgatgtttgtggcgtcccagaaataagaaagtacatttct

SEQ ID NO: 7847 - DNA, 1894 bp, Zea mays
cgggaggcaagtgcgatttcgatctcgcagccacctttttttttgttctgttgtgtatctagtagttggaggagatatgcagtttgcacttgcattggacacgaactcaggtcctcaccagataagatcttgtgagggtgatgggattgacaggttggaaaaattaagtattgggggcagaaagcaggagaaagctttgagaaataggtgctttggtggtagagttgctgcaactacacaatgtattcttacctcagatgcttgtcctgaaactcttcattctcaaacacagtcctctaggaaaaattatgctgatgcaaaccgtgtatctgctatcattttgggcggaggcactggatctcagctctttcctctgacaagcacaagagctacgcctgctgtacctgttggaggatgttacaggcttattgatatccctatgagtaactgcttcaacagtggtataaataagatatttgtgatgagtcagttcaattctacttcgcttaaccgccatattcatcgtacataccttgaaggcgggatcaactttgctgatggatctgtacaggtattagcggctacacaaatgcctgaagagccagctggatggttccagggtacagcagactctatcagaaaatttatctgggtactcgaggattattacagtcacaaatccattgacaacattgtaatcttgagtggcgatcagctttatcggatgaattacatggaacttgtgcagaaacatgtcgaggacgatgctgatatcactatatcatgtgctcctgttgatgagagccgagcttctaaaaatgggctagtgaagattgatcatactggacgtgtacttcaattctttgaaaaaccaaagggtgctgatttgaattctatgagagttgagaccaacttcctgagctatgctatagatgatgcacagaaatatccataccttgcatcaatgggcatttatgtcttcaagaaagatgcacttttagaccttctcaagtcaaaatatattcaattacatgactttggatctgaaatcctcccaagagctgtactagatcatagtgtgcaggcatgcatttttacgggctattgggaggatgttggaacaatcaaatcattctttgatgcaaacttggccctcactgagcagccttccaagtttgatttttatgatccaaaaacacctttcttcactgcaccccgatgcttgcctccgacgcaattggacaagtgcaagatgaaagatgcatttatctcagatggttgcttactgagagaatgcaacatcgagcattctgtgattggagtctgctcacgtgtcagctctggatgtgaactcaaggactccgtgatgatgggagcggacacctatgaaactgaagaagaagcttcaaagctactgttagctgggaaggtcccagttggaataggaaggaacacaaagataaggaactgtatcattgacatgaatgctaggattgggaagaacgtggtgatcacaaacagtaagggcatccaagaggctgatcacccggaagaagggtactacataaggtctggaatcgtggtgatcttgaagaatgcaaccatcaacgatgggtctgtcatatagatcggctgcgtttgcgtctacaaaacaagaacctacaatggtattgcatcgatggatcgtgtaaccttggtatggtaagagccgcttgacaggaagtcgagcgttcgggcgcaagatgcgttgtctggcatgctgttccttgaccatttgtgctgctagtatgtactgttataagctgccctagaagttgcagcaaacctttttatgaacctttgtatttccattacctgctttggatcaactatatctgtcatcctatatattact

SEQ ID NO: 7848 - DNA, 2148 bp, Zea mays
aatacttttagctgctacactgatgtgttttgcatgcagtgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttctgag

SEQ ID NO: 7849 - DNA, 1580 bp, Zea mays
cgtgacttcccctccccttctcctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggatgtttccccgggggcggcatgcctgggggtttccctgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaaccaaacggctctatggtgatgtatgcaaaaagttgctttcgaacttgatttctcaattcacagatggtttgacagtttcttgaattatagaatgcttgtgtgctgct

SEQ ID NO: 7850 - DNA, 871 bp, Zea mays
ctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgttacaagtttgatgcactgggaatgccaggcaactaatgtggtaataaacattttgccaatctttttttttcctc

SEQ ID NO: 7851 - DNA, 901 bp, Glycine max
tggaggctgtggttgctgccctgtttatgaatatttatattgttggtttgaatcaattgtctgatgttgaaatagacaagataaacaagccgtatcttccattagcatctggggaatattcctttgaaactggtgtcactattgttgcatctttttcaattctgagtttttggcttggctgggttgtaggttcatggccattattttgggccctttttgtaagctttgtgctaggaactgcttattcaatcaatgtgcctctgttgagatggaagaggtttgcagtgcttgcagcgatgtgcattctagctgttcgggcagtaatagttcaacttgcatttttccttcacatgcagactcatgtgtacaagaggccacctgtcttttcaagaccattgatttttgctactgcattcatgagcttcttctctgtagttatagcactgtttaaggatatacctgacattgaaggagataaagtatttggcatccaatctttttcagtgtgtttaggtcagaagccggtgttctggacttgtgttacccttcttgaaatagcttatggagtcgccctcctggtgggagctgcatctccttgtctttggagcaaaattttcacgggtctgggacacgctgtgctggcttcaattctctggtttcatgccaaatctgtagatttgaaaagcaaagcttcgataacatccttctatatgtttatttggaagctattttatgcagaatacttactcattccttttgttagatgaggatgcatctgcattattgacttgaaaattagttttgtttaaatggtgctgcctttgtcaaaggcaggcgttgagtcgctacgttagttttaagtttttaattgctaatttaaatgaagaattatttcttttgg

SEQ ID NO: 7852 - DNA, 1641 bp, Glycine max
cgagtaccaccaggaaaccctcgacaacctccgcgccgccatggagaacaccggtattctctgcgccgtcatgctcgacaccaaggggcctgagattcgaactggttttctcaaggacggtaagcctatccaactgatacaaggtaatgaaataaccatttccactgactatgacctaaagggagatgagaagacgatttgtatgagctacaaaaagctgcctgaggatgtgaagcccgggatggtcatactctgtgcggatggcaccatatcatttacagttttatcatgtgacaaacaagcaggcttggttcaatgccgatgtgagaactctgccactcttggcgagaggaagaatgttaatttgcctggagtgatagtggatctcccaactttgacagacaaggacaaggaagatatcttggcctggggaattccgaataaaattgacatgattgctctttcttttgttcgaaaaggttctgacctggtggaagtcaggaaagttctgggaaaacatgctaagaacattatgctcatgtctaaggttgaaaaccaagaaggggttgcaaattttgatgaaatccttgcaaattcagatgcatttatggtggcacgtggtgaccttggaatggaaattccaatagagaagatatttctcgcacagaaagtgatgatttacaagtgcaacatccaaggaaaaccagttgtcactgcaacccagatgttggagtcaatgatcaaatctcccaggccaaccagggccgaagctactgatgttgccaatgcagttctggatggcacagactgtgtgatgcttagtggtgaaaccgctgctggagcctatccagaccttgctgttcaaacaatggctaaaatatgcattgaagcagagagcacccttgactatggtgatgtgttcaaaaggattatggagcactcaccggtacccatgagcccattagagagtctagcttcttctgctgttagaacagccaactcggctagagcggctcttatcttggttttaactagaggagggagtactgcaaaattggtggcgaaatacaggccagggatgccaattctttccgtggttgttcccgagctcaagactgatagctttgattgggcatgcagtgatgaggcccctgcgagacatagccttatattccgcgggttggttcccgtgttgagtgcagcttctgctagagcttctcatgctgaaacaacagaagaagcaatagaattcgccatgcaacatgccaagtccaagggtctctgccacaacggggattcagtggtggcactgcatcgtgtgggcactgcatctatcatcaagatcttgactgtgaaatgatcacccccattacaaggaattcttctgctgtttatggcaaattttttggatggtgcaaaagaggtctcgatatacctcttcatatctacattggatgcaaacttcaattaaaagcatttattaggatcggttacctgtttttcacatatcatatattactggttttttttttttttgttacatttgccttatcattgtggcgagtagccacttgttttcatttgttaagattttgtacgaggcttttggtgaaccaaaaaactagccacatatggattttg

SEQ ID NO: 7853 - DNA, 1631 bp, Glycine max
caaatcccaactactactcacactcactgcagatctcaatccatggctaccatcgttagcatcaaggcccgccagatctttgacagtcgtggcaatccaaccgtcgaggtggatttgacatgctccgatggtacttttgctagagctgctgttccaagtggtgcatccactgggatttatgaggcccttgaattgagagatggaggatctgactaccttggaaagggtgtatcaaaggctgttgacaatgtgaacaccattattgcccctgctttggttggcaaggacccaactcagcagactgctattgacaacttaatggttcaacaacttgatggaactgttaacgaatggggttggtgcaagcaaaagcttggagcaaatgccatattggcagtgtctcttgcagtctgcaaagctggtgctgctgtcctgaaagttcctctttacaagcatattgcaaatattgcgggtaacaaaaagttggttttgcctgttcctgctttcaatgtcattaatggtggatcacatgctggaaacaaacttgctatgcaggagtttatggttcttcccgtgggagcttcctctttcaaggaagccatgaagatgggtgtagaagtatatcacaatttgaagtctgtgattaagaagaaatatggtcaagatgcagtaaatgttggtgacgaaggtggctttgcccctaacatccaggaaaacaaggaaggtttggaattgctgaaaactgccattgccaaagctggttacacaggcaaagttgtcattggaatggatgttgcagcttctgaattctacaaggaagataaaacatacgatttgaacttcaaggaagataacaatgatggctcacagaagatctctggagatgctttgaaagatctatacaagtcatttgtgacagagtatccaattgtttcaattgaggatccttttgaccaggatgactgggagcactatgctaagcttactgctgaggttggaaccaatgtacaaattgttggtgatgatctcttggttaccaaccccaagagggttcagaaggcaattgatacaaaagcatgcaatgctcttctccttaaggtcaaccaaattggttctgtgactgagagtattgaagctgtcaggatgtccaaaaaagctggatggggtgtcatggcgagtcacagaagtggagagactgaggataccttcattgctgacctttctgttggtttggcaacgggtcaaattaagactggagctccatgcaggtcagagcgtcttgctaaatataaccagctcttgagaattgaggaggagcttggtgcggaagcagtgtatgctggagctaacttccgtacccctgttgagccctactaaagttttcaagtggaaaaaacctggagatccccacgagtttgagcaatgagatttggatgcgcggttttagttgtgatcaataagtcgatagttagaacaatagtcttggtataaggaccttgccaataattttttagttctgattcacagagctaagacagttccgtcttagactttaaaagttttgatatttagctttaatacttgaagtttacttccaattttatggggtatccccaaaacatttcatactc

SEQ ID NO: 7854 - DNA, 1212 bp, Glycine max
cttctatctctgcaattcaaacacaaaaaccatggcttccactaatgctcttcctcccaccggcaacggcctcatcgtgagcttcggcgagatgctcatcgacttcgttcccaccgtctccggcgtgtccctcgcggaggctccgggattcctcaaggcccccggcggcgcccccgccaacgttgccatcgccgtcgcgagactcggcggcaaagcggcgttcgtcgggaagctcggcgacgacgagttcgggcacatgctggccggaatcctgaaggagaacgacgtgcgatccgacgggatcaacttcgaaaagggcgcgcgcaccgcgctggcgttcgtgaccctacgcgccgacggggagcgtgagttcatgttctacagaaaccccagtgccgacatgctcctcacgcccgaagatctcaatctcgaactcatcagatccgcaaaagtattccattatggatcgataagcttgatcgtggagccatgcagatcagcacacttgaaggcaatggaagttgccagggaagcagggtgcttgctctcttatgacccaaacttgcggctacccttgtggccctcggccgaggaagcacggcagcaaatacttagcatatgggacaaggctgatgtgatcaaggtcagtgatgtggaactggaattcctaactggaagtgacaaaattgatgatgcatcggctctctccctgtggcatcccaatttaaagttgcttcttgtcactcttggagaacatggttctaggtactataccaagaatttccgtggatcagtggaggcttttcatgtcaacacagttgacacaactggcgctggtgattcctttgttggtgcactattaagcaagattgtcgatgatcaatccatacttgaagatgaagcaaggttaagggaagtactcaagtttacaaatgcgtgtggggcaattacaactactaaaaagggagcaattcctgctcttcccacagaggctgatgccctcaagctgatcaaagaggcatagaaatttagtgcttgtagcttttggttttcattttatatatatcttcatccttttcacttttgtgttggacttgcttgctgtcaacttaagatggattttgtttcttggttttctttgttttatttttaccgtattctgcattaacggtaatatcatatgatttggggttttgcataatgatttctttc

SEQ ID NO: 7855 - DNA, 1454 bp, Glycine max
taggtgtctctcactctcccaccgaatccacattctaaagtaatacgccggagaatgacgtcacactcccactacccacccgacttagacgccgactccgtcacctcctccccacgctccgatcacttccacgacgcgccgccccgcatccgcttcatgtgcagcttcggcggcaagatcctcccccgcccccacgacaaccagctccgctacgtcggcggcgacacccgcatcgtcgccgtcaaccgctccatcactttctccgccctcattctcaaactctccaaactctcaggcatgagcaacataacagccaagtaccagctcccgaacgaggatctggacgcgttgatctcggtcaccacggacgaggacgtggagaacatgatggacgagtacgaccgcgtcgcacacaatcagaacccgcgatcggcgcggctccggctcttcctcttccccgaaggagaagactcccgcgccagcagcatcagctcgctcctaaacggctcagccaagcgcgaaaactggttcctcgacgctttaaacggcggcgtttcgggcctcgaacgaggccgctccgaagcctcttctatggtctctgaagtacccgattacctcttcgggttagacaactccgaagaaataacaaatcaccaacgcgacccgagacccaaacccggacccattattcaagataacgtttccgtttcagatccgggttcgcccgccccggttgtctcgtccccttattgttccacgtcatcagcgccgcccgtgccctctctcccgaaccttccctatgttaaaaccaaacctttaaacttaaatccggttcctgatactgactccaaggaaaatcaaaccgaacctgaaacggaacctcacccgaacctgaacctgaaccaaaacccgaacatgtattcaaataaccctgttgttcactaccctccagaagctgcttattcggcgcattcagtaaacccggttccggtttactatgtttccggtccggttcgaccgggatccgtgccggttcctatgcaaaccccttatcactacgttcaacaatcgtatcatgctgtggtgccacctcaggttcctatcgggtaccatcctttggttccgggttcgggtcaagtatatggagcgggcgtgaggcacatgaccccactgcaaccttacagcccctccaccacggcggtggttcatgacggtttgaaacagcacgtgtatcatgccgtgccaaattcgggtccggttccggttcacccagttattccgatgacgggtttggatgaaccgcagagaggtggagcgtaatttgtgacgggtcggggccccaattcacttaataactgatcccatttttatttagtggatgggtgctgaatttttactaccataccatcatgcaaatggtaatttatgtctatatatatacaagtgccttcact

SEQ ID NO: 7856 - DNA, 727 bp, Glycine max
gggagctgaaaaaaatgggagaaagtgctttgttctctgccaaactctacacagagaacgataacaacattttttagtcctttataatgccagttccacttgccccatacccaacaccaccagctccatatacaccaccagctaatggtgtacagagtcaacttgtctgttctgggtgcagaaaccttctagtgttcccagttggagccacctctgtgtgctgtgctgtttgcaatgctgtcacagcagtaccacctcctggcacagaaatggcccagttagtatgtggaggttgccatactttactcatgtacatccggggcgcgacaagtgtgcaatgttcttgttgtcacactgtcaatctagctttggaagcaaatcaggtggcacatgtcaactgtggcaactgcaggatgctactcgcgtaccaatatggagcaagatccgtgaaatgtgcagtttgcaattttgtaacatcagttggggccacagcaagcaccactgagcagaagttcagcacttaaaacatacaaaatagcgaggtcattatagactctacaaccttggttttgctagtcacatatcgcccgtaaggaataaagagttatcagattggagaggaaactagtatcacatgtatagagttatttttctcttgcgtgattgtattaaatatatttttgtttgattgggtgtatcaaaaactatttatgataagttttcagtt

SEQ ID NO: 7857 - DNA, 1709 bp, Glycine max
ttcttcttagtatcgagctacatatttcacagccatgttgccaagaagtagaacccttcctagcagaatccaccaaggaattatagaagagaggcacgatgtcaggccctacgtacaagtagaagtgcgacccaataatatccaaacggagacccaagcgatgaatatccagtctaactattccaagtgcttcgatgatgatggtcgcttgaagagaacaggaacattttggacggcaactgctcatatcatcactgctgtgatagggtcgggagtcctttcactagcatgggcggttgctcagcttggttgggttgctggacctgttgtcatgtttctctttgccgtcgtcaatctctacacttccaacctattaacacagtgttacaggaccggtgactccgttaatggacacagaaattacacctacatggaggctgtcaagtccatcttgggaggaaaaaaggtcaagttatgtggcctcatccaatatatcaatctgtttggagttgcaatcgggtacaccattgctgcctctgtcagtatgatggccataaaaaggtcgaattgctatcacagcagtcatggaaaagatccctgccacatgtcaagcaatgggtatatgataacatttggaatagcagaagtgatattttcccaaatcccagactttgatcaggtgtggtggctatccatagttgcagctatcatgtccttcacttattcttcagttggattgagtcttggagtggccaaagtagcagaaaataaaactttcaaaggaagcctgatgggaattagcattggcacagtaacacaagccggaacagtcaccagcacacagaaaatatggaggagtttacaagctcttggggcaatggcctttgcatactccttttccattatcctcatcgaaattcaggacaccataaaatctcctcctgcagagcacaagaccatgagaaaggccacaacattgagcatcgcggttaccacagtgttctatttactctgtggatgcatgggttatgcagccttcggagataatgcacctggaaatctcttgactggttttgggttctataacccttattggcttctggacattgccaaccttgcaattgttatccacctagttggggcatatcaggttttttcccagcccttatttgcatttgtggaaaaatggagtgtacgcaaatggccaaagagcaattttgtcacggcagaatatgatataccgattccctgctttggtgtgtaccaactcaacttcttccgcttagtatggagaaccatttttgtgctgttgacgaccctcatagccatgctcatgccttttttcaacgatgtggttggaatacttggcgcttttgggttctggcccttaacagtttatttccctatcgacatgtatatttcgcaaaagaagattggacgatggactagtcggtggattggacttcaattacttagtgtcagttgcctcatcatttcattgttagctgcagttggttccatggcaggggttgttttggacctcaagacttataagccatttaaaactagttattaagtgagatttaaagaaggtcgtagaaatagaagtgtttaagcttgatgatattatagaaaactaatgataagttggtttgtgaaatttaagtatatacgctccatgccgctgctgttagagcaattgatttgag

SEQ ID NO: 7858 - DNA, 1147 bp, Glycine max
cttctacagcattcttctgcaattcaaatcaaattttcaaaccatggcttcctccaccaacgctcttcctcccaccggcaacggcctcatcgtgagcttcggcgagatgctcatcgatttcgtccccaccgtctccggcgtgtcccttgcggaggctccgggcttcctcaaggcccccggcggcgcccccgccaacgtcgccatcgccgtcgcgaggctcggcggaaaggcggcgttcgtcggaaagctcggcgacgacgagttcgggcacatgctggctggaatcctgaaggagaacgacgtgcgatccgacgggatcaacttcgaccagggcgcgcgcaccgcgctggcgttcgtgaccctacgcgccgacggagagcgtgagttcatgttctacagaaaccccagcgccgacatgctcctcacgcccgaagatctcaatctcgaactcatcagatctgcaaaagtattccattatggatcgataagcttgatcgtggagccatgcagatcagcacacctgaaggcaatggaagttgccagggaagcaggatgcttgctctcttatgacccaaacctgcggctacccttgtggccctccgccgaggaagcacgtcagcaaatactcagcatatgggacaaggctgatgtaatcaaggtcagtgatgtggaactggaattcctaaccggaagtgacaaaattgatgatgcatctgctctctccctgtggcaccccaatttgaagttgctccttgtcacttttggcgaacatggctctagatactataccaagaatttccatggatcagtggaggcttttcatgtcagcacggtcgacacaactggcgctggtgattcctttgttggtgctctattaagcaagattgtcgatgatcaatccgtacttgaagatgaagcaaggttaagggaagtactcaagtttgcaaatgcgtgtggagcaattacaactactaaaaagggagcaattcctgctcttcccacagaggctgatgccctcaacctgatcaaagaggcatagaaatttaatgctagtagcttttggttttctttatatatatgtcttcatccttttcctttcgcgttggacttgcttgctatcaacttcagatggattttgtttcttggt

SEQ ID NO: 7859 - DNA, 1063 bp, Glycine max
ctctcatccagatcttgcaaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaatattaagatat

SEQ ID NO: 7860 - DNA, 1736 bp, Glycine max
ctggccttttgttctcgtgtcaatttctaaatccaccaccacaccctctcttctattctctattattattatctccacacccttcactctctctcactcttctctcgaatcttccaccgcaatggccaccgctgccgagaaactctccgctctcaaatccgccgtcgccggattgaacgaaatcagtgagaatgagaagaacggattcatcagcctcgtcggccgctatctcagtggcgaagcgcagcatgtggaatggagcaagatccagacgcctacggacgaagtggttgtgccttacgacactttggcgccaactcctgaaggttcttcggaggtgaagaatctattggacaagcttgtggtgttgaagctaaatggaggcttgggaacaactatgggttgcactggtcctaaatctgtaattgaagttcgtgatgggttgacatttctagatttaattgtcatccaaattgagaatctcaattccaaatatggaagcaatgttcctttgcttttgatgaattcattcaacactcatgatgacactcaaaagattgttgaaaaataccaaaactcaaatattgagattcatacttttaaccagagccagtatcctcgattggttgttgaggactttttgccattgccttccaaagggcatactgacaaggatggatggtaccctcctggccatggtgatgtcttcccatcattattgaacagtggcaaacttgatgcactattgtcacagggtaaagagtatgtgtttgttgccaattcggataacttgggagctatagttgacttgaaaatcttgaatcatttgatccagaacaagaatgaatactgtatggaggtgactcccaaaacattggctgatgtaaagggtggcactttgatttcttacgaaggaagggttcagctcctggaaattgcacaagtccccgatgaacatgtcaatgagttcaagtcaatagagaagttcaaaattttcaacacaaataatttgtgggtgaacttaaacgcagttaaaaggcttgttgaagctgatgctcttaagatggaaattattcccaatccaaaggaagttgacggaataaaagttcttcagctggaaactgcagctggtgctgcaataaggttctttgacaaggctattgggattaatgttcctcgatcacgattccttcctgtgaaggcaacttcagatttgcttcttgtccagtctgacctctacactttggaagacggatttgtcattcggaacaaagctagggaaaatcctgaaaacccttctattgaactgggaccagaatttaagaaggttagcaacttcttgggccgcttcaagtcaattcctagtatcgttgagcttgacagtctaaaagtggctggtgatgtatggtttggagctggtgttatcctcaaggggaaagtcagcattgtatcaaagcccggtgtaaagctggaagttcccgacggtgttgccattgtagacaaggaaattaatggcccagaggacctgtgaggaagacagatgactttaactaaagaatgaattgtatcagaccgtatcttatctatctatatggtctagtgtttttactactcccatgtttgataggtaaagaaaataagaagtctttttgttgagaggatgtcttggtgtggatctttactccattgtcttggaattctgtttagaacagcaaaaaaatgacaagtttggtgat

SEQ ID NO: 7861 - DNA, 2274 bp, Glycine max
tgggcgcctccaccacctgatccacctctgtttcttcttcctttcatccgttcatacgggggttagatgatggagtcctgtgattgtatagatacgcagtatccgccggatgaacttcttgtgaagtatcagtatatctcggatgtgctaattgctcttgcgtatttttcgattccggtggagctcatctattttgttcagaagtctgctttctttccgtatagatgggtgcttatgcagtttggtgcctttattgttctctgtggagcaactcatttcataaacctgtggacattctctccgcactctaagtctgttgctgttgtcatgacgattgccaaagtttcgtgtgctattgtgtcatgtgcgacggcactgatgcttgtacacattattcccgatctgttgagtgtcaagaggcgcgaatcgatcctcaagaacaaggctgaagagcttgacagagagatgggacttattcttactcaggaagagacgggaagacatgttagaatgttgactcatgaaattaggagcacacttgacaggcatacaattttaaagactactcttgtggagctggggaggactttgggcttggaggagtgtgcattatggatgccttcgagaagtggtctgaatctgcaactttcccatactttaacctatcatgtgcaagttgggtctacggtgcaaacaaacaatcctattgtcaatgaagttttcaacagccctcaagctatgcggataccacccacctgtccattggccaggatcagacctcttgtgggaagatatgtgccccctgaagttgttgctgttcgggtgccgcttttgaatctgtcaaattttcaaattaacgattggcctgatatttcagcaaagagctatgcaatcatggttctcatcctccctactgacagtgttagaaaatggcgagaccatgagttggaacttgttgatgttgttgcagatcaggtagcagttgccctttcacatgctgctattttggaggagtctatgcgtgcccgtgatcaactcatggagcagaatgttgctttagatttagcccggcgagaggcagagatggcaattcatgctcgcaatgattttcttgctgtcatgaatcatgaaatgaggacaccaatgcatgcaattatagcattgtcatcacttctcttggagactgaactgacgccagagcaaagggttatgatagagacagtgttgaagagtagtaatgttttggcaacactcattaatgatgttctagatctttctcgacttgaagatggtagcctcgaattagaaatgggaaaattcaacctccatggagttttgggagagattgttgaactgataaaaccaatagcatccgtgaaaaagttacctatcaccttaattctgtctcctgatctgcctactcatgccattggtgatgaaaagcggcttacacaaactcttttgaatgtcgtgggtaatgctgtcaaattcactaaggagggctatgtttctgtaagagtatcagttgcaaaaccagaatcttcacaggattggcgacctccagagttttatccagcatctagtgatggccatttctacattcgagtccaggttaaggactctggatgtgggattctcccacaagatattccgcatctctttaccaagtttgcccagtctcggagtggaccagctcgacctagcagtggtgcaggtcttgggcttgccatttgtaaaagatttgtaaacctcatgggaggccacatatggattgagagtgagggccttgacaaaggaagcacagctacatttatagtcaaacttgggatttgtggcaatccagatccatccgatcatcaagctgcaaacagaagccaagcatatagtggaagtggtggcctcgctagatttaaacccttcatcacagatgaaaacgacactggtttttctactagacgcaatcaaagaagtttctaatatccaagacaccaaaattgcatacctctcaatcacagtcgacaagatggagtaaacctcctactttcattttgcatgtgctaaattgtataatttgcagtttgcggctgtagaataggattactatgtcaggcatatttctaacaaacaggttttatgcgaactcctgttgtattaactagaatacaatacaacaaaacaaagttgagagacgatctgttacttaatttgacttgtagtatatattgtcagtggcttttgccgtttagcgttcataaaaatgacagtattggcatg

SEQ ID NO: 7862 - DNA, 1468 bp, Glycine max
atatatactatgatgagagtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgt

SEQ ID NO: 7863 - DNA, 1521 bp, Glycine max
gccccgggcccgtgcgccgcggcgctgtcggactcctgctcactccccaacaacaaaatccaagaccaattccctctgccacccagggctgtccacagtttggcgaaggaaaaacaacatattccttcgccaccacaagtggacagtcctgtctctgtctcagtctcggtctcttcctcctcggacgacgaggacgaggagatcgtgcaagccgtagtgtcgggctccatcccgtcctactcactcgagtcgcggctcggtgacacccgtcgggccgccaccatccgccacgaggtggtgcagagactgacttcccgatccctgtcaggtttacctctggaaggtttcaactacgactcgatattggggcagtgctgcgagatgccgatagggttcgtgcagatccccgtgggagtagcggggccattattgttggatggaaaagaattcaccgtgcccatggccaccactgaagggtgtctggttgcgagcaccaacagaggttgcaaagctatatacgtctccggtggggcctcctcggtgttgcttagggatggtatgaccagagcacccgttgttcggtttccctccgcccagcgcgccgcgcagttgaaattcttcttggaggatcctctcaacttcgattctcttgctgtcgttttcaataagtcaagcagatttgccaggttgcagaatattcagtgtgctattgcgggcaagaatttgtacatgagattccgatgcagcactggtgatgcaatggggatgaacatggtgtcaaaaggtgttcaaaatgtccttgattttcttcagagtgacttccctgacatggatgttattggaatttctggaaatttctgttcggacaagaaagctgcagccgtgaattggattgaagggcgtggcaagtctgtggtgtgtgaggccataattaaggaggatgtggtgaagaaggtgttgaagaccagtgtggaggccatggtcaagcttaacatgctcaaaaaccttacgggttcagccatggctggtgctcttggtgggttcaatgctcatgctagcaatattgtgtctgctatctacattgccactggtcaggatcctgcccagaatgtggagagttctcactgcatcaccatgatggaagctatcaatgatggcaaggaccttcatgtttccgtgaccatgccctccattgaggttggtactgttggaggtggcacacaactcgcatctcagtcagcatgtcttaatttacttggtgtcaagggtgccaacaaagaatctccgggtgcaaattctaggctactggccaccattgtagccggttcagtcctcgccggggagctatcgctcatgtctgctattgcagctggacaacttgttaagagccacatgaaatacaacagatctagcagggatatatctacaattgtccaatgaactggccacagtacacttaaacttgtgtcagagactaatattctaataagcaaaccatcagataaagacataaataacgag

SEQ ID NO: 7864 - DNA, 1289 bp, Glycine max
agaaaatcggaaagtccacgcgccgccccggctcgtcctccaaggcccgcgtctacgccgatgtcaacgtcgttcgccccaaggaatattgggactacgagtccctcaacgtccagtggggggagcaagatgattatgaggtggtgaggaaggtgggtagggggaaatacagtgaggtgttcgaaggtgttcactgcacggacggtgagaaatgtgtcattaagatcctgaaacccgtgaagaagaagaagatcaagagggaaatcaaaatattacagaatctttgtggagggcctaatattgtacagttgcttgacattgttagagaccaacagtcgaagaccccaagtcttatatttgaatatgtcaataacactgattttaaagtgctctatcctacattgtcagactacgaaatacgatattatatttatgaacttctgaaggcactggattattgccattcacaaggaatcatgcatcgtgatgtgaaaccacataatgtaatgattgatcatgagcagcgtaagcttcgccttatagattgggggcttgcagagttctatcatcctgggaaagaatataatgttcgcgtggcatcaagatatttcaaaggtcctgagcttcttgttgatcttcaagactatgattactctctagatttatggagtcttggttgtatgtttgctgggatgatattccgtaaggagccattcttttatggacatgataactatgatcaactggtcaaaatagctaaggtacttgggacagacggattaagtgcatatttagataagtatcgaatagagttggacccacatcttgcagcacttatcgggaggcatagccgcaagccatgggcaaagttcattaatgtagaaaatcatcacatggctgttcctgaggctgttgactttgttgacaagttattacgctatgatcaccaagaacgtcccacagcaaaagaagccatggcccatccatacttcaatccagttagaaatgcagaaagtagtagaactcgtgcacattgagttgctggtgcttgttgtgatatggtgttcgttcttgtcagggggccttcaacagtctgaactgttatttctagtggaacttgcttttagtagattcccctgttctgttgtgaaactcatttcaattagttctttatctaatcgttttgtttctggtttttaaaattatttttgggtggaaaattcagctctcaacaattttatttgattgtgtgccaaaatttggaaatgaaatgttgattcaatttcagt

SEQ ID NO: 7865 - DNA, 1450 bp, Glycine max
gtgcggtttcctttgttggtgttgctgggaactgttttcctggcatcagtttgtgtctcattaaaggtgagagaggatgagaataaccctttctacttgagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaagggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgt

SEQ ID NO: 7866 - DNA, 1113 bp, Glycine max
cggatatctcaaaggtttatccttcagtgaagagaaatggcagctgaggcaaattttgatagcaaaagcagcaggtggtctttgcaggggatgacagctctcgttaccggtggttccaaaggaatcggatatgctatcgtggaggagttggcacaacttggagccactgtacacacttgcgctcgcaacgaagctgaactcaataaatccttaaatgaatggaacacaaaaggatacagagtaactggttcggtccgtgacgtggcgtctcgtgcagaaagacaagacctcatagctagagtctcaaatgagtttaatggcaaactcaatatccttgtaaacaatgtgggaacaaacatacagaaagagaccctggatttcacagaggaagatttcacatttctggtgaatacgaatcttgaatcttgtttccacctaagccagcttgcacatcctctcctaaaagcttcagaagctgcaaacatcattctcatatcctccattgctggtgtggtagcttcaaatatagtatccgttgtgtatggtgcaacaaaaggagcaatgaaccaaatgacaaaacatttggcatgtgaatgggccaaagacaatataaggactaattgcgttgcaccagggccaattagaacccctcttggtgacaagcactttaaagaggaaaaacttaataatagtctgattgcgcgaacccctcttggacggattggagaggcagaggaggtttcttcgttggtggcattcctctgcttacctgcagcatcttacataacaggacaaaccatttgtgttgatggcggcttcaccgtgaacggtctctacataagctaggcttattgtgacagtttcaatgttttgtttagtctgttacactctacttgtattagtttctctttaagttgtggagagtggagaccctatatctgtttttaaggacgtgataataacagtactcagtgataagtttgtttttcttgttttgatttagtcacatgtcccatgattctaggagcagtataatcgtgggcagtttatcctatttcccgttggttgtaaggctttcaataataataataataatagccatgtttgcttttc

SEQ ID NO: 7867 - DNA, 1761 bp, Glycine max
cactcctcctttctctctctttcattattgagacttctttccagatttctcaatctatggctctgcattttcttctcctgctgctttttgcagtgtctgttgttgcagctgatgaagaaccatttataggagtgaatattggaacggatctctcagatatgccacaccctactcaagtagtagctctactaaaagcccagcaaattcggcatgttcgattatatgatgcagaccaagctatgctccttgcacttgcaaagacaggcattcaggttgctgtgactgtcccaaatgaagagatcctagcaattggtcaatcgaattccacggctgccaattgggtttcccgcaatgtggtagcgcattatccagccaccaatatcactgccatttgtgttggttctgaggttttaactaccctcccaaatgcagcaaaagtacttgtcagtgcgattaaatacatccattcggcccttgtggcatccaatcttgatcgccaagttaaagtttcaacacccctttcctcttccatcatccttgattcatttccaccttcacaggctttctttaatcgctcactcaatccagttttagtcccactacttgatttcttgcaatccactggctcttatctaatgctaaacatatacccttactatgactacatgcaatcaaatggagtgattccgttagattatgcactcttcaagtctctccctcctaacaaagaagctgttgattccaatacccttctccactacaccaatgtctttgatgccatggttgatgcagcatactttgccatggcctttctaaattacaccaacattcctgtagtggtgaccgagtcagggtggccctcaaaaggtggctccaacgaaccagatgcaacggtcgacaatgcgaatacttacaacagcaatttgatcaagcatgtgtttaacaaaaccggaactcccaagcatccaggaatagatgttagtacatacatctatgagctctacaacgaggatatgaagtctgggccattgtcagagaagaactggggactgtttgatgccaatgggacacctatttacattctacacttgacagagtcaggggcagtcttagcaaatgatactagcaataatactttctgcattgcaaaggacggtgctgacccgaagatgctgcaggctgcactagattgggcatgtggaccggggaaggtcgaatgctctccattgctgcagggtcaaccatgctatgaaccagacaatgtgattgcgcatgcaaattatgcatttgacacttactatcataagatgggaaagactcctgatgcatgtgacttcaatggagtggctacaatctccacctcagatccaagtcatggttcttgtttatttcccggaagtgttggcaaaaatggaaccttaggtaacttcacagctccttccatgaattctacaaattcagattcctcagcctacaaattcagctgtgacttgagaattagaagccttttaatggtaacaggatttctattatggggagtggttttgctataaagtggtatatgtcagaacgtgttactttgaaattttttgtggtggatgataatgctacatattcgtcttggtacgattctattgttcatagtggtccattcaattttgtacaaaaaccagctaagggtttggaccgaatgaggccgcaactgaattatcatcatcatcattattattcttttcaactagaattgattcaatctttatc

SEQ ID NO: 7868 - DNA, 1602 bp, Glycine max
tcactacacttttttcactttctcgggaaaatcacagcgacgctcaggaaaaactctaaactgtgaaaaaaccactgcgatcaatggcaacgatcaaggccgtgaaagctcgccagatcttcgacagccgtggaaatccaaccgtcgaagttgacgttattctcagcgatggaagcttccacagagccgccgtgcctagcggtgcttcaacaggtgtttatgaggctttggaattaagggatggaggctcagactacctcgggaaaggtgttctcaaggctgtggagaatgttaattcaattatagcacctgctctgcttggcaaggacccaacgaagcagactgaaattgacaattttatggtacagcagcttgatggaactgttaatgaatgggggtggtgcaagcagaagcttggagccaatgctattttggcagtgtcacttgctgtctgcaaggctggtgctgcagtgaagaaaattcctctgtacaagcacattgccaatctggctggaaacaagactttggtactgcctgtaccttcattcaatgttatcaatggaggctcacatgctggaaataagctagcaatgcaggaatttatgattctccctgttggggcatcttccttcaaagaagcaatgaaaatgggcgtagaagtataccatcatctaaaggctgttattaaaaagaaatacggtcaggatgctactaacgttggtgatgaaggtggctttgctcctaatatccaggaaaaccaagaaggtcttgagcttctgaagactgccattgccaaagctggttacactggaaaggttgtaattgggatggatgttgctgcttcagaattttatgataacaaggacaaaacctatgacttgaattttaaggaagagaataatgatggatcacagaaaatctcaggagacagcttaaagaatgtgtacaaatcatatgtgacagattatccaattgtgtccattgaggatccatttgatcaggatgactgggagcactatgcaaaattaacagctgaagttggccagcaggtgcagattgttggtgatgatctccttgtcaccaacccaaagcgggtggagaaagcaatcaaggagaaggcttgcaatgcccttctgttgaaggtgaatcaattggtagtgtaactgaaagtattgaagctgtgagaatgtctaaacaagctggttggggtgtcatggctagccacaggagtggtgaaactgaggataccttcattgctgacctctcagttggattagcaactggtcagatcaagactggagctccctgccgatctgaaaggcttgccaagtacaaccagctcctgaggattgaggaggaacttggttctgctgctgtgtatgctggtgccaaattcagagcccccgtggagccctactgattgtttagcccaagattactaagcatcatttaaataagattctattgatgactgcataggacatgtattttttgcgaaaaataaacttgtctactacttcagagaatataggttttccgggcgtggaattttgaagcgagaaaataaggcagtagatgtatgcctgatgcctagtttatttg

SEQ ID NO: 7869 - DNA, 795 bp, Glycine max
atcactttgtcccttttcatacattcacatattcattttgccacaccttaaaaccaagcacccggccatatttcaatttttgttttggttagttgtcatgaagagagaaagagaggttgatagcttaaccatggcgaattgtttgatgttgctttctcgtggaagtgaatttgaggccacctactcaagcacttctatgagcaatcgtgtctttgagtgcaagacatgtaataggcaattcccttcatttcaagcacttggtggccacagggctagccacaaaaagcctaggttgatggcaggagatatcgaaggccaattgcttcatgattcacccccaaagcctaagactcatgagtgttccatttgtgggttggagtttgctatagggcaagccttgggaggtcacatgaggaggcacagagcggcgaatttgaatggaaacgtgcacaattctacggctacgagtagtagtagtgggggtagcagttttgattcatcgccaaagaagaaagctgacaacaagagagttttggttttggatttgaatctgacaccctttgagaatgatttggagtttttgaagattggaaaaccaaccacttttgttgattatttgtattgattgatctgttgagtgtactgttaattaaacttaggaaggtatagtttgtgtatcatagataggtgaatgctttgtttttttaatctaccgtctatatttgtttatcatactgtatgaaaaattgctcatttcttgggcaaaattagaacttcatcatgatattctgagtc

SEQ ID NO: 7870 - DNA, 930 bp, Glycine max
gagccattcgtgagcctagagttgttgtacagactaccagcgaagtagatatcctcgatgatggttatcggtggcggaaatatggacaaaaagttgtcaaaggaaatcccaacccaaggagttactacaagtgcacaaatgcagggtgcacagtaaggaagcatgtggagagagcatcacatgaccttaaatctgtgatcactacgtatgagggaaagcacaaccatgatgttccagctgctcgtgccagcagtcacgtcaatgctaatgcttccaatgcagttcctggccaagcttctcttcagacccatgttcacagacctgaaccatctgaagttcacaacggcattggaaggcttgagaggccttccctgggctcattcaacctacccgggaggcagcaactaggaccttcccatggcttctccttcggtatgaaccaatccatgctatcaaatctggtgatgtcagggttgggccatgcgcaagcaaagcttcctgtcatgcctgttcattcattcttggcagcgcatcaacaacaacagcaacatcaacaacaacaaaaccaacaacaacgtgcggcaaatgatttgggtttcatgttgccaaagggagagccaaatgtggaggctattcctgaacgtggtggccttaacctgtcaaatggctcatcagtgtaccaagaaattatgagccgcatgcctcttggacctcatatgtaaaattttattccctgattctttaaataaaaactaatgtttacatcttttatatatatatatatatatatatatatatatatatatatatatatatatatatatatatatataatgccaaggcatacataggtggacttttcattattagactcttttgtatttgacattcttcaacacatgtcaaaggtatatgtagtttatttttctc

SEQ ID NO: 7871 - DNA, 1989 bp, Glycine max
cacttgttcaattactccttcaaatcagtctggcttgacaagcaggaaaggtatttattgctctctacttaggtaacataagccaacaattttagtagtaattaatggctggagaattgggagttttgaatgcacttgatgtggcaaagacacaatggtaccacttcactgctattgtgatcgctggaatgggtttcttcaccgatgcctatgacctcttctgcatttccctagtcaccaagcttctagggaggctatattacacagaaccaggtgcaccaaagccaggttcacttcctccaagagttcaagcttctgtgactggtgtagcactatgtggcacattagccggccaactattctttggttggcttggtgacaaaatggggagaaaaagagtctatggactaacactcattctcatggtagtgtgctcccttgcctcaggactctcctttgggtcaactccagagggtgtcatggcctcactttgcttcttcaggttctggctagggtttgggattggtggtgactaccctctttctgccacaatcatgtctgaatatgccaacaagaagacgcgtggcgcgttcatagccgcggtgtttgcaatgcaaggattcggaatcctggctggtggagtggtggcattgattgtttcatatgcatatgaccaaaagtacaagcttcctagttatgaacagaatccagaagcatccttggaccccgcatttgactatgtttggagaatagttttgatgtttggtgcagttcctgctgcactcacctactactggcgcatgaagatgccagagacagcacgttacactgcccttgtggccaagaatgcaaaacaagctgctgcagacatgtctaaggtgttgcaagtggaacttgaagctgaagaggagaaggtgaagaaattgacagagaatgagagcaacaagtatggtttgttcaccaaggaatttgtgaaacgccatggcctgcatttgttgggaaccaccaccacttggttcttgttggacatagcattctacagccaaaaccttttccagaaggacattttcagtgcaattgggtggatccctccagcaaaggaaatgaatgcaatccacgaggtgtataagattgcaagagcacaaacactcatagcactatgcagtactgtgccaggttactggttcacagtggcattaattgattacatgggccgttttgccatccaattgttggggttcttcttcatgactgtgttcatgtttgctttggctataccatatgatcattggtctgagaaagaaaacagaattgggtttgtggtgatgtactctttcacctttttctttgccaattttggtccaaattccaccacatttgttgtgccagcagagattttccctgcaaggctaaggtccacttgccatggaatctctgctgctgcaggaaaggctggtgcaattgtgggtgcatttgggttcctatatgctgcacaaagcaaggacccttccaagactgatgcagggtaccctactggtattggaattaagaactcactcattatgcttggtgtgatcaacttcattgggatgttgttcaccttgcttgttccagaatcaaagggaaaatcactggaggagttgagtggggagaatggtgaaaatgatgctgaacatgcagtgtctgctaggacagttcctgtttgattgaagttaagtttgtgttcaacaatgtggttcaacttcaaattgtgatatgtgtacattttaatactgggttttggttgtgacgtgtttacaccaatgatgtagtagttgcacggttcagggtgctagagcttaaaaataattacagtttgtttgcttttggttcttacttttgtttttttttttgtttaaaatagatacctggtaattttacttttgattatttgtaaagttttattgttttgttatttaatcacaatttatgattaatttattgtctttt

SEQ ID NO: 7872 - DNA, 1457 bp, Glycine max
gatgagagtgcggtttcctttgttggtgttgctgggaactgttttcctggcatcagtttgtgtctcattaaaggtgagagaggatgagaataaccctttctactttagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgtttggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctctacctatcttctatctactacgaataaataaatccagcatacgatgcttgtgttttgt

SEQ ID NO: 7873 - DNA, 2040 bp, Glycine max; identical to SEQ ID NO: 7776

SEQ ID NO: 7874 - DNA, 1464 bp, Glycine max
gatgagagtgcggtttcctttgttggtgttgctgggaactgttttcctggcatcagtttgtgtctcattaaaggtgagagaggatgagaataaccctttctactttagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgtttggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctctacctatcttctatctactacgaataaataaatccagcatgcgatgcttgtgttttgtagccttc

SEQ ID NO: 7875 - DNA, 1455 bp, Glycine max
tgagagtgcggtttcctttgttggtgttgctgggaactgttttcctggcatcagtttgtgtctcattaaaggtgagagaggatgagaataaccctttctactttagaagctctaacagcttccaaactctctttgagaaccaaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgtttggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctctacctatcttctatctactacgaataaataaatccagcatacgatgcttgtgttttgt

SEQ ID NO: 7876 - DNA, 648 bp, Glycine max
acagttttctgtgtcaccggaactcgtttctttcaaaacacttcaaacatctcgaacgctctctttccggcaactaggttaaagttcatcaatggcaggtcgcggcaaaaccctaggatctagcgccgccaagaaggctacctcaaggagcagcaaagccggcctccaattccccgtcggccgtatcgcccgtttcctcaaggccggaaaatacgctgagcgtgtcggcgccggcgcccctgtctacctcgccgccgtactcgaatatctcgcggctgaggttttggaattggctggaaacgctgcgagagacaacaagaagactcgaattgtgccgcgccacattcaattggcggtgaggaacgacgaggagttgagcaagctactcggtgacgtcaccatcgctaacggtggcgtcatgcctaacattcacaatcttctccttcccaagaaggctggtggatcatccaaggctgctgctgcagacgatgactcttaaatagggtttttttttccgtgaaaagttatcgaatttattctctttggattctctctgtttttgtagtttttcagtttttgataattgtgttctgtagatgtagttaggttttcagtcactgatgtgaatagagaacgctctttttcttc

SEQ ID NO: 7877 - DNA, 1557 bp, Glycine max
tgcgattgcgatggtgaaatcgaacgagaacggttctggttccgtttcggtgcctcctttcctgaaaaaatgttacgatatggtggaagaccgcaacactgattctatcatccgttggagcgatggcggtgacagctttgtcatctccgacatcactcaattctccgtcacgctccttcccacctatttcaaacacaacaatttctccagtttcatcagacaactcaatatctatggtttcaggaaaattgatacggattgctgggaatttgccaatgagaactttgttagaggtcaaaagcatttgttgaagaatatacgtagaaggaaacatccacacagtgcagatcagcaaaaagcattgccacagcaagacaattgtgatgaaccatcacaagaagcaccgtatcatggcctttggaaagaagttgagaatctaaaacttgataaaaattcgctcacgcaagaattggtcaaacttaggcaacaccaggaatctgctgagaataagttgctgctcctgagtgatcgccttcaaggaatggaaaagcatcagcagcagatgttatcatttttagtcatggttgtgcaaagccctgggttcatggttcagcttcttcatcctaaggaaaataattggcatttggctgaatcatggaatatattggatcaagataaacaagatgacaagccagttgcttctgatgggatgataataaagtataaaccacctgtaggtgaaaaactaaagcctgtagttcctctgtctcctggtttcgaaaagcaaacagaacccgagctttctgcagaagggctaaaagacttgtgcgtcagttctgaattcttgaaagtgcttctggatgaaaaattatctccattagaaaatcattctccatttctcctaccagatttacctgatgatggttcatgggaacagctttttctaggtagtcctttcatgggaaacattcaagattctaataaagaaagtgaggggcacaccaatggtggaatggagatggaaccaacaatatctgagactccaaatgaaaattctcgaacttttgaatcgatgattgtagagatggagaaaactcgagaatgagttggagttgtatgcacatggtgggctgtcttcttggaatccatcagatatttttcagctgggctgtctcatactgagctaatggagctttagtttctgaaactaacaatatatagggaaggaagtaataatgtccatcagatatttttcagctgggctgtcttcacagattacttcacactataattatattatagtattaagtcgcaattattttctctcccatcttccttcagcagttgttagatcctcttctagaatccatattttggcttcctgatacatggtgtcggagatcaggagttgtatggtagtgcacaagtgcggcgacctatatatatagcggatcaattatttcttttatggaaaattgtaagggaaaacggcaactttattttttgtgccacattaaacagtggcacttgccttcatatatattataaaatttcacg

SEQ ID NO: 7878 - DNA, 1285 bp, Glycine max
cacccctgacttgaacctcttaccgtgcgcatcttctcaatccataacaacttcgccaccgttgcaccgaaaccaatcgccacaaactcgggatctcagattcgacgcgccaaaccatgtcgaaggcgcgtgtctacacagatgtcaatgtccttcgccctaaagagtattgggattacgagtctctcacccttcaatggggtgatcaagatgattatgaggttgtgcgaaaagtgggcagggggaaatatagtgaagtttttgaaggcataaatgtcaatagcaatgagcgctgtataatcaagattctgaaacctgtcaagaaaaagaagattaaaagagagataaaaatacttcagaatatttgtggaggcccaaatattgtcaagcttcttgatattgtcagagatcaacattcgaaaactcccagtttgatatttgagtatgtcaacagtacagattttaaagttttgtatccaaccttgactgattatgacatacgctattacatatatgagctccttaaggctttggattactgccattctcaaggcattatgcatagggatgtcaagcctcataatgtcatgatagatcatgagttacgaaaacttcgcttgatagattggggtcttgctgaattttatcatcctggaaaggaatataatgtccgtgtggcttcaagatactttaaggggcctgaacttctagttgatttgcaagactatgactactcattagacatgtggagccttggctgcatgtttgctggaatgatatttcgcaaagaacctttcttttatggtcatgacaaccatgatcagcttgtcaaaatagctaaggtgcttgggactgatgaactgaatgcatatcttaataagtatcatctggagcttgatcctcaacttgatgcacttgttggaagacacagtcgaaaaccctggtccaaatttatcaatgcagataatcagcatcttgtgtctcctgaggcaattgattttcttgataagctccttcgatatgatcaccaggacaggctaacagctagagaagcaatggcacatccatatttctctcaggtaagggcagctgaaagtagcagaatgaggacacagtaacttgatcacatatggatccataaacttgagttaatatatttgggatttgttttatgataccctaacacgcaccttcgttaccgtctgtttattacagagattagttttcctgtggagtgtattgacattatgttgcagttgaggaataatgttattgccagttattg

SEQ ID NO: 7879 - DNA, 1595 bp, Glycine max
cccggttatcatggttcaggcataccgcttacttgtggctgaaatgtatgtccaaggctgggattatccattacacttgggtgttactgaagctggagaaggtgaggatgggaggatgaagtctgcaattggcattggaactcttcttcaggatggattgggtgatacaattagggtttctctcacagaaccaccagaagaggagatagatccttgcagaaggttggcaaatcttggaatgagagcttctgaactccagaagggggtggaaccttttgaagaaaagcacagacattattttgacttccagcgccgatctggtcaattgccagtgcaaaaagagggtgaggaggtggattacagaggtgcactgcaccgtgacggttctgttctcatgtcagtctccttggatcagttaaagatgccagaggtcctctacaagtcacttgctgccaaactcattgttggcatgccatttaaggatttggcaacagtagattcaattttattacgggaacttcctccagtagatgatgctgatgctcgactagcactcaagagactgatagatatcagcatgggggttataactcctttgacagagcagctaacaaagccattacccaatgccatggttctagtaaaccttaaggaaatatctaccggagcttataagcttttgccacaaggaacacgcttggttgtgtctgtccgaggtgatgagccttatgaagaactggacattcttaagggtgttgatgctactatgcttctccatgaccttccttatacagaagacagaattagcagagtgcatgcagccagacggttatttgagtacctatctgacaattctctaaacttccctgttattcaccatattcagttcccaaatgggattcacagggatgacttggtaattggtgctggttctgatgctggagcccttctggttgatgggcttggagatggactacttttggaagccccggacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccctggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagagcatggacgatgggtggaccctcctgcagaggagtaaaggcaagagctcaattttgagattggcattcaagtccaatgtaagatgatcattgttatagcctattattgtacacatgtaaagtaagcactgaatgcttaagtttgagcatagttttaagttaaggatcacaattaaagcttgggcggtgaggaaatcgacagctataacaagtatacagacaacatcaataataataataataataatgataatttcttgg

SEQ ID NO: 7880 - DNA, 1733 bp, Glycine max
ctaaaattaaattgtgcataaattaaaatcagctttttgaataagttaaatgtgttaaatttctccaaaaagctgactttaacttgtatataagctaactttaactttatgggagaaacttgtgaatgtgtttactctttcttatttttttctttttatcttacaagtacttatcctaatagagtctaagcatagcaatagtacaaacttaaaaacatttggggcctatcagatggctttggttatcagctttttatataaatcaaggtttcggttgatagaggttacaatgggaaattggaacttgatgcttaatacgtttccatttccacatcttttgctctgtccctctgccttgaatgaaatttgaacttataagatcaatacttttgcaggaaatacaattgggaatgggtccttgtggagagctcagatatccatcttatccagaaaccaatggaacttggaggtttcccggaattggagaattccaatgttatgacaaggtattaaaaaaacattaatttaaaccttttttgtacattaatcctaaagaatgattgtattggtaatgtttcaaagccattggtccctattgacatatcacaaggatatcacacaaaagagagagaaaatttcaaaatatctatggactaaaatgacttgtttgtcatgcagtatatgaaagcatccttggcagcagcagccgaagacattggaaagaaagaatggggaggaggtggaccccatgactcaggccagtacaatcaatttcctgaggatactggatttttcaaaagggaaggaacatggaacactgaatatggacagttctttctggaatggtactccggtaaattgctggaacacggtgagaggatccttgtatctgccaaaggaatatttgaaacaactggggtgaaactatcagggaaagttgcaggaatccactggcattacagagcaagatctcacgcagctgaactaaccgctggctactacaacacacgaaataacgatggatatctgcctatagcaaggatgctcgcaaaacatggagttgtcttcaatttcacctgcatggaaatgaaggacagagagcagccagactttgcaaactgctcacctgaagggttagttcaccaggtgaagatggcaacaacaacagctagagcagagcttgcgggggaaaatgcattggagagatatgatgcagatgcatatgctcaagttttatcaacaagtaagtcagaatccggcagtggattggctgcattcacatatctaagaatgaacaagaggttgtttgaagctgacaactggcggcacctagtggatttcgtaagaagcatgtctgagggtggtcggagagagagacttccggcagctgattcccatgggagtgatctttatgttgggcacatcaaagcaacacaggaaaagcacacacaagaggctgctcttgtgtaattgcatatttttgcaagttcaggcatcttggtatatagttaaaagcatcataagatatttttttatagaaaaagggaagctacagaaaaaaaggagaaatgacataggatcatgatacagaacactggcatatgtcatgccaacacctgagatgatcgagaagatattattttatttcatgtaatgtataactccaactacaatggagaaaaaacagtttatctgctgacgttataaacccaataatacagatattggtctct

SEQ ID NO: 7881 - DNA, 1329 bp, Glycine max
gcgggaacaacaacaactgaagaaagagagagagagagagagagagaggtgtgaagttggtgaaggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggagggagatgatgatgatgaagacgatgctgatgatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaatgcttagacaaatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgatta

SEQ ID NO: 7882 - DNA, 1888 bp, Glycine max
ttttcacttttgttcatcgtttgcgagacacacaggagagaagagatggcgacgagggtggtggcggaacagaagccgaagacgaagattgtgtgcacgctggggcccgcatcgcgctctgtcccaatgatcgagaagcttctgcgggcgggcatgaacgtggctcgcttcaacttctcccatgggtcccacgagtaccaccaggaaaccctcgacaacctccgcgccgccatggagaacaccggtattctctgcgccgtcatgctcgacaccaaggggcctgagattcgaactgggtttctcaaggacagtaagcctatccaactgaaacaaggtaatgaaataaccatttccactgactatgacctaaagggtgatgagaagacgatttgtatgagctacaaaaagctgcctgaggatgtgaggcctgggatggtcatactctgcgcggatggcaccatatcatttacagttttatcatgtgacaaacaagcgggtttggttcaatgccgatgcgagaactctgccactcttggtgagaggaagaatgttaatttgcctggagtgatagtggatctcccaactttgacagacaaagacaaggaagatatcttggcctggggagttcccaataaaattgacatgattgctctttcttttgttcgaaaaggttctgacctggtggaagtcaggaaagttctgggaaaacatgccaagaacattatgctcatgtctaaggttgaaaaccaagaaggggttgcaaattttgatgaaatccttgcaaattcagatgcatttatggtggcacgtggtgaccttggaatggaaattccaatagagaagatatttcttgcacagaaagtgatgatttacaagtgcaacatccaaggaaaaccagttgtcactgcaacccagatgttggagtcaatgatcaaatctcccaggccaaccagggctgaagctactgatgttgccaatgcagttctggatggcacagactgtgtgatgcttagtggtgaaaccgctgctggagcctatccagaccttgctgttcgaacaatggctaaaatatgcattgaagcagagagcacccttgactatggagatgtgttcaaaaggattatggagcactcaccagtacccatgagcccattggagagtctagcttcttctgctgttagaacagccaactcggctagagcagctcttatcttggttttaactagaggagggagtactgcaaaattggtggctaaatacaggccaggcatgccaattctttctgtggttgttcccgagcttaagaccgatacctttgactgggcatgcagtgatgaggcccctgcaagacatagccttatattccgcgggttggttcccgtattgagtgcagcttctgctagagcttctcatgctgaaacaactgaagaagcaatagaattcgccatgcaacatgccaagtccaagggtctctgccacaacggggattcggttgtggcacttcatcgtgtgggcactgcttctgtcatcaagatcttgactgtgaaatgatcaccccattacagggaattcttctgctgtttttggcaaattttttagatggtgcaaaagaggtctcgttatacctcttcatatctacattggatgcaaacttcaatcaaaagcatttatcaggatgggttacctgtttttcacatatcttatattactgttttttttttttttgttacatttgccttatcattgtggcgagcagccacctgctttcatttgttaagattttgtatgaggcttttggtgaaccaaaaaactagccacttctggattttgaattctacggtctaaagttgttttaattgagaagtgtatgccttttcgtagcattggc

SEQ ID NO: 7883 - DNA, 1915 bp, Glycine max
aggaaatatgccgttacctctataatcatcaaaacaaggatggtgggtggggtttgcatattgaaggtccaagcaccatgtttggctctgtcttgagttatattactctgagattgctaggtgaggggcctaatgatggacaaggggaaatggagaaggcacgtgactggattctagggcatggtggtgctacttatataacgtcatgggggaagatgtggctttcagtacttggagtgtatgaatggtctggaaataatcccctgccccctgagatatggctccttccatacatgcttccatttcatccaggaaggatgtggtgtcactgccggatggtctatttgccgatgtcctacttatatggcaagaggtttgttggtccaatctcaccaacagtattatctttgagaaaagagctttatacagtaccataccatgatatagattgggatcaggctcgcaatttgtgtgcaaaggaagatttgtactatcctcacccacttgtacaggatattctttgggcatctctacacaagttccttgagcctattctgatgcattggcctggaaaaagattgagggaaaaggctattatttctgcattggagcatatacattacgaagatgagaatactcgatatatttgcataggtcctgtaaataaggtgttaaatatgctttgctgttgggtggaagatccaaattctgaggccttcaagttgcatcttcccaggatttatgattatctatggattgcagaagatggcatgaaaatgcagggctacaatggaagtcaactatgggacactgcttttgctgtccaagcaattattgcatctaacctcattgaagaatttggtccaactataagaaaagctcatacctatattaagaattcacaggttttagaagattgtccaggtgatcttaataaatggtaccgtcacatttcaaaaggtgcttggcctttttcaactggagatcatggatggccaatttctgactgcacagctgaaggactgaaagctgttctattactatccaaaattgcaccagaaatagttggtgagccaatagacgtgaagcgattatatgattctgtaaatgtcattctctcactacagaatgaagatggtggttttgcaacatatgagcttaaacgatcttataattggttggagataatcaatcctgctgaaacttttggtgacatcgttattgattatccttatgtggaatgtacatcagcagcgattcaagctttggcatcatttaggaaattatatcctgggcatcgccgagaagaaatacaacattgtatcgataaagccactaccttcattgaaaaaatacaagcttcagatggatcatggtatggttcttggggagtttgcttcacttacggtgcttggtttggggtaaaaggtctgattgctgctggaaggagtttcagtaattgctcaagcatccgtaaagcttgtgaatttctgctgtccaagcagcttccttctggtggctggggagagagttatctgtcctgtcaaaacaaggtgtattcaaatctggaaggcaacaggtctcatgtggtcaacactgggtgggctatgttggctctcattgatgctggacaggctaagagagattcgcaaccactgcaccgggcagctgcatacttgataaattcccaattggaggacggtgactttccgcagcaggaaataatgggagtcttcaacaagaattgcatgatcacatacgccgcatacagaaacatattccccatttgggcgttgggagaataccaatcccaagtattgcaatctcgttaatcgagccttagttagggtgtcatcctaattatttcgacctgtggacagtaaaagaaataataataataacctatttttctttt

SEQ ID NO: 7884 - DNA, 1494 bp, Glycine max
gtttcttctgcagctatggcgattcaagatcaaaatggatttttcagatcacagggtggtcctccagaaggaggtggtgtatctttgagttctgggcattctgtcacacatattcaacttaatgaccagttttcttgtgggaatgactatgctctgaaggtaaggaagccgtatactatcactaaacagagagagcgatggacagatgaagaacataagaagttccttgaagctttaaagctgtatggacgggcttggcgacgtattgaagaacatgttggcacaaagactgctgttcagattcgaagtcatgctcagaagtttttttctaaggttcttcacgatcctactgggaacaatacaaacacagtggagtcaattgaaattcctcctccaagaccgaaacgaaagccgatgcatccttaccctcgtaaactagttgagaccccaaataaggaaatttcgatcccagaacaacctatgaagtctaattctctgaagtcgtcagactttgatcaagaaaaccaatctccaaaatcagtattatcaggagttggttcagacagccttggctcctctgattcagacacaccaaatggaagtttgtcgcccatgtcatccattagtggcttccatacaagcagttttacacgtgccaaacccaaaacaacaacatctgaggaagaagctgggatggacactgattcaactcatgatgagaaacctcttatgaaattcaagcttcctccaaatggatgtgtttccatcaaagaagacaacacagcagaagaatcttccggtcggactttcaaactctttggaatgactctatttgtaacagacacctgcaaaccatctccaacaatcgaggaatgctaaagatacctctaaacattcgcgcgcaacgcctttcctcctccatggaggatggcaaattggaacttgttggacactctagagcaagtgaaacatcagcaatatccaagctaaaggtgagagtggaacctgaagcatgtgggaaagggtttgtgccatataaaagatgcatatctgttgtgacagctgatgatagagaagagcaatgtatccatctttccttgtagcttataccccactggatttttccttcaaaaagtgttccctttgtcatgatgagctgtaatggttgttttggttgctgctggatgtgagttggtatgatataggaaggaaaaaggggtggctgaaaattttgatatttccgttgaattgcactgcactgcacattctccagctgttcaaatccgtaaacttgccttttctatttttttgacttccaagtttcaacacattctccgcgggtccaagccgtgtctgtgcgcggcacttaggagctgtgtccgtgcttcctagtttaactgtgaataactgtgaattatatctagtgccttttttttaaaaaaaaaaaaaactttttatgctccctaagagtatgcaaagtgtaagtcacgtact

SEQ ID NO: 7885 - DNA, 1197 bp, Glycine max
gcgaatccctctctctctttctctttctctctcatccagatcttgcaaaaaaaaaaaaacacaatggcagcgagcgctcccactccacgtgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaatattaagatattgttctctagcaaacttggtattgctaattgttttagcatgtgaaggtgtgacacctttatttgtttttattctaaagcctcggaatcatttattccgatcgatttt

SEQ ID NO: 7886 - DNA, 1063 bp, Glycine max
ccctctctctatctctcacacacactttctctctctctctctctcacccagatcttgtagcaatggcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccatt

SEQ ID NO: 7887 - DNA, 1714 bp, Glycine max
cagctttcttcttagtatcgagcttcatatttcacagccatgttgccaagaagtagaacccttcctagcagaatccaccaaggaattatagaagagaggcacgatgtcaggccctacgtacaagtagaagtgcgacccaataatatccaaacggagacccaagcgatgaatatccagtctaactattccaagtgcttcgatgatgatggtcgcttgaagagaacaggaacattttggacggcaactgctcatatcatcactgctgtgatagggtcgggagtcctttcactagcatgggcggttgctcagcttggttgggttgctggacctgttgtcatgtttctctttgccgtcgtcaatctctacacttccaacctattaacacagtgttacaggaccggtgactccgttaatggacacagaaattacacctacatggaggctgtcaagtccatcttgggaggaaaaaaggtcaagttatgtggcctcatccaatatatcaatctgtttggagttgcaatcgggtacaccattgctgcctctgtcagtatgatggccataaaaaggtcgaattgctatcacagcagtcatggaaaagatccctgccacatgtcaagcaatgggtatatgataacatttggaatagcagaagtgatattttcccaaatcccagactttgatcaggtgtggtggctatccatagttgcagctatcatgtccttcacttattcttcagttggattgagtcttggagtggccaaagtagcagaaaataaaactttcaaaggaagcctgatgggaattagcattggcacagtaacacaagccggaacagtcaccagcacacagaaaatatggaggagtttacaagctcttggggcaatggcctttgcatactccttttccattatcctcatcgaaattcaggacaccataaaatttcctcctgcagagcacaagaccatgagaaaggccacaacattgagcatcgcggttaccacagtgttctatttactctgtggatgcatgggttatgcagccttcggagataatgcacctggaaatctcttgactggttttgggttctataacccttattggcttctggacattgccaaccttgcaattgttatccacctagttggggcatatcaggttttttcccagcccttatttgcatttgtggaaaaatggagtgtacgcaaatggccaaagagcaattttgtcacggcagaatatgatataccgattccctgctttggtgtgtaccaactcaacttcttccgcttagtatggagaaccatttttgtgctgttgacgaccctcatagccatgctcatgccttttttcaacgatgtggttggaatacttggcgcttttgggttctggcccttaacagtttatttccctatcgacatgtatatttcgcaaaagaagattggacgatggactagtcggtggattggacttcaattacttagtgtcagttgcctcatcatttcattgttagctgcagttggttccatggcaggggttgttttggacctcaagacttataagccatttaaaactagttattaagtgagatttaaagaaggtcgtagaaatagaagtgtttaagcttgatgatattatagaaaactaatgataagttggtttgtgaaatttaagtatatacgctccatgccgctgctgttagagcaattgatttgag

SEQ ID NO: 7888 - DNA, 977 bp, Glycine max
ggaacactgaatatggacagttctttctggaatggtactctggtaaattgctggaacacggtgagaggatcctcgtatctgctaaaggaatattccaaacaactggggtgaaactatcagggaaagttgctggaatccactggcattacagagcaaggtcacacgcagctgaactaactgctggctactataacacacgacataacgatggatatctgcctatagcaaggatgctggcaaaacatggagttgtcttcaatttcacctgcatggaaatgaaggacagagagcagcctgactttgcatattgctcacctgaagggttagttcaccaggtgaagatggcaacaacaacagctagagcagaacttgctggggaaaatgcattggagagatatgatgcagatgcatatgctcaagttttatcaacaagtaagtcggaatccggcagcggattggctgcattcacatatctaagaatgaacaagaggttgtttgaaggtgataactggcggcacctagtggattttgtaagaaacatgtctgagggtggtcggagagagagacttccagcagctgattcccatgggagtgatctttatgttgggcacatcaaagcaacacgggaaaagcacacacaagaggctgctcttgtgtaattgtatatttttgctagcttaggcatcttggtatatagttaaaagcatcataagatatttttcatagaaaaagggaagttacaaaagaaaaaaaaaaggagaaatgagatagtatcatgacatagaacattagcacatgtcatgccaacacctaagatgatggagaagattttatttcatgtaatgtgtatataactacaactacaatggagaaaaacagtttatctcctgacattataaaccacttgaatgtaactagagatgattgaatggaaatcctcaagtgtgttctccacacttaggctctattatattatt

SEQ ID NO: 7889 - DNA, 1441 bp, Glycine max
ctttcttttactagcacctagctaggactcaattctttggttacttaatagtagttcctttttaactatctttcttcaatggctgactcagcctcagcctcagcctcttcttccagaatgtggtgctccatccccgaaaggtttcagctgcatgcggccatgttggccctgcagtttggctatgccggcttccatgttgtctcaagagctgcccttaacatgggcattagcaaacttgttttcccagtctaccgcaacattatcgcttttctcttgctcgttccttttgcctacttcttggaaaagaaggagagacctgccattacattaaacttcctcttacagttctttcttctggctcttgtcgggattacagcgaaccaaggtttctacttgcttggcttggacaacacatcccctacctttgcatcagccatccagaactctgtcccagccattacatttctcatggcagtcatactcaggatcgagcaagtgcggctgaaccgaaaggatgggatatcgaaggtggcgggaacgatattctgtgtggctggggcaacggtgattacactatacaagggtccaacaatatatagcccaactccacctctacacagtgagagaccagcagtagttgactttggaacactctcactgggagatgcaaaggggaaaaactggacccttgggtgcctctacctcatagggcattgcttgtcctggtctgcttggcttgtgctccaagcacctgtactcaagaagtacccagctcgtctctccgtcacttcctatacatgtttctttggactcatccaattccttgtcatcgctctcatcgttgaaagggatgcccaggcttggattttccaatctggtggagaagttttcactattttatatgcgggagtggtggcatctggaatagccttcgctgtacagatatggtgcattgacagaggtggccctgtgttcgttgccgtgtatcagcctgttcaaactcttgttgtcgctattatggcttccattgctttaggcgaagagttctacttgggagggatcataggagcagtgttgatcgttgtgggactgtactttgtcttgtggggtaaaagcgaagagagaaagtttgcaaaggaacatgctgctattacgtccaccccagagcacagtggcatcaggtcctcaagccatgccaaaacatcactcactcagccacttctcccttcatctacggagaatgtctgatcaacaaaaccatgacttcaagctggggcaccattttctgggagagaaaaagggaaaaaggaggaaaaagaagaaaataatacccagttatacattattactactttgtgtcaggaagcttgtgtgtgtacgaaggggctttcatctttttttcttttttttttttggttaattcacatgctttctttctagg

SEQ ID NO: 7890 - DNA, 1445 bp, Glycine max
caagttactatctataattaattaaattcctcgtggaatattgaagaagccatgtctacagctgggcaggtcatcaagtgcagagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatcttttttttgtg

SEQ ID NO: 7891 - DNA, 1641 bp, Glycine max
gagagcgagaaaccacgtttctctcttgaggttaattattattattattgagtattgagcatggaggcgccatctctcaccaaacccaacgacccaacaaaaccttccaacacttccagcacccttagtctggagggggggccgggcgaagcgagcccactccgaaaaatgtttgcggtggcgtccatcgccgccggcatacagttcgggtgggctctgcagctgtctctcttaaccccctacgttcagctcttaggagtcccccacgcggcggcctccttcatctggctctgtgggcccatctcggggctggtggtgcagcccattgtgggctactacagcgaccactgcacctctcgcttcggccgaaggcgccccttcatcctcggaggcgccttagccgtcgccatcgccgtgttcctcatcggctacgcggccgacataggacactccgctggcgacgacataactaaaaaaacccgaccccgtgcagttggggtcttcgtcataggattctggatcctagacgtggccaacaacatgctccagggaccctgccgcgcctttttagctgacctcgctgccggcgaccagcaaaaaacgagaatcgccaacggtttcttctcgttcttcatggccgtcggcaacgtgcttgggtatgctgcagggtcctacagcggtctccacaagatcttccccttcacggagaccaaggcctgtgacgtcttctgcgcaaacttaaaaagctgtttctttttctcgatcctactgcttctctttttagcaactgttgctctgctctacgttaaggacaagcaagttgaagcaattcctctggatgatgccactcaaccctcttgtttctttcagcttttcggtgctctgaaagagctcaagagaccgatgtggatgctgatgctggtcacagctgtgaactgggtggggtggtttccttacttccttttcgacactgactggatgggtcgtgaggtctacggtggaactgctggggaggacgcgtacgcgaagggagtgcgcgtgggatcgttagggctgatggtaaacgccgtcgtgttgggcttcatgtcgttggcggtggagccgttggggaagatggttgggggagtgaagaggctttgggcgattgtgaactttattctcgcgattgggttcggaatgacggtggtgatcaccaaggtggcggagcaccagcgccggatgaaccccgccgccgtgggccacccctccgagggggtggtggttgggtccatggttttctttggggttcttggagttccccttgcgattactttcagtgtcccttttgctctagcatcaatatactgcagcgcttcaggagcaggacaaggtttatctttgggagttctcaatcttgcaattgtggtaccacagatggtggtgtctgcattaagtggtccttgggattccttgtttggtggtggcaacttgccggctttcatggtgggtgctgcggcagccgcgttgagcgccataatggcgattgtcttgctgccaactccaaagccagctgatgaggccaaggcttcaagcatgatggcagggggctttcactagttaatggagttttgcatgtttcagttttgtcccctgctttaatag

SEQ ID NO: 7892 - DNA, 2027 bp, Glycine max
tgaaagttgaaaaacaatggatggcttgttttgtttttatgatgatgagtagtattatataataatttatgggagcagaaagacaagacaaaacaagagagaatgagtggcggaggaggaggagaagaggaagcaactctggagttcactccgacgtgggttgtggccgccgtttgcacagtcatcgtcgccatatctctcgctgctgagcgcctccttcattatggcggaaagtttctcaaagccaaggaccagaagtcgctctacgaagctctccagaagatcaaagaagagctgatgcttctgggcttcatttccctgcttctcacggttacacaaaacggcattaccaaaatctgcgttcgtcccagtttgacgcgccacatgctcccttgtaatctcgacgccggtgaacactccacgcctgagtccgagtccgccactaaaattggttactgcgtccgcaaggtcacaccctctcactccctcacttttcttttccttagatctcatctaatccaccacccctcgtcctcgccttttgttttgtttttcactttttcagaacaaggtacctttattatctttggaagcacttcaccatcttcacatcttcatttttgtcctcgctgtcgtacacgtctccttttccttactcaccgttgtcttcggaggcgccagaatacgtcagtggaaacactgggaagattcaattgctaaacagaactacgaaactggccgagttctcaaaccaaaggtcactcaggtacaccagcatgattttatcaggggtcgttttgccggttttgacaaagactctgctattgtcggttggttgctatcctttttaaagcagttttatggatctgtgacaaaatcagattatgtgacattgcgacatgggttcattatgacccactgcaggacaaatccaaagtttaattttcacaagtacatgattcgtgccctcgaagatgatttcaagcaagttgttggtataagttggtatctttggctctttgtggttatcttcttgttgcttaacatcaatggttggcatacgtatttctggattgcttttattcccgtcgttcttttacttgctgtgggcactaagctggggcacgtaataacccaactagctcaagaagtagctgaaaagcatgcagccatagaaggtgatttagttgtgcagccatcagatgaacatttttggtttcatcggccccatgttgtcctctttttgattcactttatccttttccaaaatgcctttgagatagcattttttttctggatatgggtcacatatggatttgactcctgtataatgggacaagttcgatacattgttccaaggcttgttattggggtatttattcaggtactatgtagctacagcaccctgccactgtatgcaattgttacgcagatgggaactcactataagagggcaatatttaatgagcatttgcaacaaaacattgttggttgggcacagaaggcgaagaagaggaaaggactaaaagctgatggcaatcctggccaaggaagttctcaggagagtgctaatacaggaatccagcttgggtcaattttcaagaaggcatctgctccaggaggcagttcttctgccaccaaagctgatgggaccaactcagtgtagcctatagaagtgaagatttacagtcttattttgtaaagttgctcacaaattgcagttttctttatattattttgtttgctaacagtgtagcattgtgggacatgtgtttgacttggtgtaggcgtaaggtcgaagttctatatgagtagatgctagtaatgccattggcatttctaacttctaagattcgtcatcacctccttactacactcgtcctccctcaggtttttgcctctgatacttccgtagacaggctgacactgcctttctctctaacttgagttcctgttaaaattatgtgtcttttatttaatgtaaagttaagctactttaggttgataaagttcaagacaaacttggt

SEQ ID NO: 7893 - DNA, 837 bp, Glycine max
ctttgttatcaaagacttaaatcaacacgttggacgagtttttttctgtctgtagctgtcggaagtttgaaacatacatattcttcttaattttgggtcagtagtatgtggaagttgaagatagcagaaggaggagatgggttaatctctgtgaacaatttcattggacgtcaacactgggagtttgatcctaatgctggaactccacaagaacgtgctcaagttgaaagggtacgagaggaatacaaaaagaaccggttttgcattaagcaaagcggtgacctactcatgagaatgcagctcacaaaggagaacacgtgtgggcccattctagcaagagtgaacgtgaaagacacggaaaacgtaacggaggaagcattgatcactacaatgagaaaggctatcaatttctattcctctattcaagcccatgatggccactggccagcagaatctgctggccctttgtttttccttcaacctttggtaatggcactctatattacagggtccctaaatgatgttttaggaccagaacaccagaaggaaattattcgttatttgtataatcatcagaacgaagatggaggttggggattgcatatagagagtcacagcacaatgtttgggtcagcgttgagctacattgccttgagaattcttggagaagggcctgaagatggtgaagacagggcaatggctagaggcagaaaatggatcctcgaccacggtggtttggaagctattccatcctggggaaagttctgggtcacggtacttggagtttatgagtggtcaggctgcaacccacttccaccagagttattatttgggtat

SEQ ID NO: 7894 - DNA, 1649 bp, Glycine max
ggggtacgtccttggcctaagggtatcacctcagcacaggagaaaagggattggctcaagccttgtgagaacactagaagaatggttcacttcaaaagatgtggactatgcatacatggcaacagagaaagacaaccatgcctcagtgagtctcttcatggacaagtttggctacaccaagttcaggactccagctattcttgtcaaccctgtgaaccatcattgctttcaaatatcacccaacattgagatagcaaggttgaagattgaccaagctgagtacctctatagaagattcatggggtccacagagttcttccctaatgacatagggaatatacttaggaacaagctaagtttggggacatgggtggcatatttcaaaggagatattgcttggggtgattttgggtcagatggacaagtaccaaatagttgggctatgcttagtgtatggaatagtggggagatattcaagttaaggctagggaaagcacctttttcttgcttggtatgcactaagagttggtggttgattcataagatcttcccatgtttgaaattgccaaccatacctgatttcttcaacccatttgggttctatttcatgtatggggtgcaccatgaagggccattttcagggaagctagtgagggccttgtgccaatttgtgcacaacatgggtgctgagtccaaggatgagagtaattgcaggatcattgtgactgaagttggaggaagagatgagctcaaccaccatatcccacattggaaattgctctcatgcccggaggacttgtggtgcataaaggcgttgaaaaatgaagggacaaataacaagttccatgaattaacaaccaaaaccccaccaacaagagctctttttgtagacccaagagaggtttaaagcatgcatgatctcacaaaaaaaaaaaagaaaaaaaaagtaatgaaaggggacaagaaaaaagcttggaaaatatcttcaccttaattttttttttcctttccttagctttgtctcagagaaccaaagcccacctcatgtattgtgtgataagtccatccatctctcctggtgggggtttttctctagttcctttcacatcggtgacacaaaatctcaaaagatatccataatttaggtgccacactttggtgttcttctttgcaattccccatcctgtgcctcatgactctgactactcaatcaccatggtggtccaaactttgtcccttcccctctagtaaattttttagctggaccctcctccctcgctttgtcgcatcgcatcgggatatggtctctttaacatgtatgtatgttaatgttaatgtcatcactaaaaaaaaaaacagaggcttcgagccattttatatatagtgtgagatcatgaaagtaacccttagttattattctctattctatgatctattcaagccaagagttagacaacttctgttccaagataaagggggaaaagatagagaaaaaaaaatgcaagtgagtctcaaggggttttggtttcttcttcattttgtgatcgagcattgtattgtctctaaccccatgaggaatgttgatgatggtgtaaagtttccttggctcgtgtgggaataaaaaaaaaactcaaaagagactttgcttc

SEQ ID NO: 7895 - DNA, 1183 bp, Glycine max
aagagggggtcagagtgagaaagagaaagagagaattcgtaaaccctaatttcggaaagatcggcgatgactgcctccaaggatcgcgagaacttcgtctacatcgccaaactcgccgagcaggccgagcgttacgaagagatggtggaatcaatgaagaacgttgcgaatctcgacgttgaactgacggtggaggagcggaatttgctttctgttgggtacaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgtttttatttgtgtggtgtctggaaatggcctatttcattcccaatccgtttcctccagtctctgggggatttgattgatgagaattgcttatggtgggtgtatttccttttccaatgaaatgctacaacatttactgcaa

SEQ ID NO: 7896 - DNA, 1118 bp, Glycine max
ggggaagaaacatttaatttgggttgataatagtttatgttaagatatcactactgctatatatatgttgccatagccaagttagccttataaagggaaactcacttgccttatttttggttttgagattgagctaaaggccaactcaaccatcgaatttgttggtgattgaaagagaaggaagaagaagcaggaaatggaagcagtgagagctggtcgagaaggagcaataggtctaggtcaaggtgatggcgtagccaaggacagcactgagactgaactcaccaaaatccgtctcctcagggcaattgttgaaacccgtgatccctcttccaaggaagaggatgattttatgattagaagattcctgcgtgctcgtgatttagatgtagagaaggcttcggcaatgctcctcaagtacttgaaatggagaaattcatttgttccaaatggctctgtatctgtgtcagatgttcctaacgaacttgcacaagataaggtgttcatgcaaggacacgacaagataggtcgacctatacttatggtcttcggtggaagacattttcagaacaaggatggtcttgatgaattcaagcgatttgttgtttatgttcttgataaagtatgtgcaagtatgccacctgggcaagaaaagtttgtcggtatagcagaacttaagggatggggatactcaaacagtgacgtgcgtggatatcttagtgctctatccattttgcaggattactacccagagagattggggaagttgtttattgtgaacgcaccatacatctttatgaaagtgtggcaaattgtttacccattcattgacaacaaaaccaagaaaaagatagtatttgtggagaaaaataaggtgaaatcaacactgctagaagagatggaggaaagtcaggtcccagagatattcggtggctcactgccattagtcccaattcaagatagctaattaattaagtaaccgctgacagaataaggagaggcgggcctaaaaataaatattgttatttcttatttatgtgtttctatgccgttttctttttacccaattactttacactgttgtatcagctatcaatattcagtagtaaatgagtacg

SEQ ID NO: 7897 - DNA, 1312 bp, Glycine max
ttcatcttctggttttggatcattcagcgccacacagacatacatggctcttgagtcagctcctgcttcagctgacatcagaggagttcacactcatggtggaggctatgttcagtataatatctatggaaacctctttgaggtctctaggaagtatgtccctcctattcgccctgtgggaagaggagcatatggaattgtttgtgctgctgtaaatgcagagacgcatgaagaagttgccattaagaaggttggcaatgcatttgacaacagaatagatgccaaaaggaccctacgagaaattaaacttcttcggcacatggaacatgaaaatgtgatagcccttaaagacattattcgaccaccacaaaggtataacttcaatgacgtgtacattgtttatgagttaatggatactgatctgcatcaaataattcaatccaatcaacaattgactgatgatcattgtcggtattttctgtatcagttgttacgaggactcaaatatgtacactcagcaaatgttctgcaccgtgatctaaagcctagcaacttgctactgaatgccaactgtgatcttaagattgcagactttggtctcgctagaactacatctgagactgatttcatgactgagtatgtggttactcggtggtaccgagctccagagttacttcttaattgctcagaatatactgccgccattgatatttggtctgttggttgcatccttggtgaaatcataacaagacaacccctatttctggggaaagattatgttcatcagctcaggctgattacggagctcataggctcacctgatgacactagccttggatttctacgaagtgataatgctcgtagatatgtgagacagcttccacaatatccaaggcaacaatttgctgctagatttccaagtatgtctcctggtgctgttgatttgttagagaagatgcttgtctttgatccaaataggcgcatcacagttgaagaagctctgtgtcacccatacttggctcctcttcatgatattaatgaggaacctgcttgcgttagacctttcagttttgattttgagcaaccatctttcactgaagaagatatcaaggaactcatctggagagaatctgtgttattcaatcctgatccacctatttattgagatttggaatttactatcatatgtgcatagtgaaatactttttgactggattacaacactaccgaggagttgttagctctctacagaagtatttaacatattggatatactgagattcttttggtaaaaattatttgaaatttaatg

SEQ ID NO: 7898 - DNA, 1696 bp, Glycine max
gtgagagagagatggcaggtatcgctggtacatgtcctttaggagcattgctcagaaacagtgtctcagaaaacaatgggaagatatctgtggttcattatgaggggcttagattgcagcagagaatgcaaatgccttcaccaagccagtacatttcagcttcttcatcagctccaagatgcagaacaatcaaggccatggcttccccaactgttggagcaccaaagagagaaaaggatccaaaaaagcgggtagtaataacaggaatgggtcttgtgtcagtctttggtagtgacgttgatgccttttacaacaagcttcttgagggagaaagtgggataagcctaatagataggtttgatgcctcaaacttctcggtccgttttggaggtcagatacgtgatttctcttcagaaggctacattgatggcaagaatgaccggcgccttgacaattgctggaggtattgcattgttgcaggcaagagggcccttgatgatgccaaccttggaaagcaagtccttgacactatggacaaaacaagaataggagttctggtgggatcaggaatgggaggtataacggctttctcgaatggtgtggaagctcttgtacaaaagggatataagaaaattactccatttttcattccctactccatcaccaacatgggttctgccttgttggctatagacacaggcctaatgggtcccaattattcaatttccactgcttgtgcaacggcaaattactgcttttgtgcggctgctaatcacattagaaaaggcgaagcagatatcatggtggttggtggaactgaggctgcaatcatgcctagtggtcttggaggcttcattgcttgcagggctttgtctcacagaaacgaagaccccaagaaggcttcaagaccatgggacaaagatcgtgatggttttgtgatgggtgaaggctctggtgtgctggtaatggagagcttggagagtgcaacaaaaaggggagccaaaataatagcagaatatttggggggtgccataacgtgtgatgctcatcacatgactgatccaagagctgatggtcttggagtttcatcttgcataagcaagagtttagaagatgctggagtttctcctgaagaggtgaactatgtgaatgctcatgccacgtcaacactggctggtgacttggctgaggttaatgcaattaaaaaggtttttaaggacacatcagaattgaaaatgaatgcaactaagtcaatgattggtcatggtcttggggctgctggtggtttggaagccatagcaactatcaaagccataacaactggctggttgcatccaagcattaacctagataacttggaggctagtgttacaattgacactgtccctaacgttaagaagaagcatgaagttaatgttggtatatccaactcatttggattcggtggacacaattcagtagttgtctttgccccattcaggccataagtaggattcaaactcaatctgagtatttcttttactttgtcttttttttttctttacacattttgagaaccagtgatttttggacacaaattcataggactatgagttatggactgaaaatagttgtttcattatgtattgaaatcatatacccagatcgtgtggtctaatgtaatgagccctgaagtcaataaaatgtaattttcagc

SEQ ID NO: 7899 - DNA, 1153 bp, Glycine max
gtgaaccttctagaactataatagacttatattccatggctccgccgctcgaacacaacggcgtttccaccagcggtgactctctgagatctattccgacgccgtttctcaccaaaaccttccaactcgtcgacgatcacaccatcgaccatgtgatttcgtggaacgattctggatcgtccttcatcgtctggaacaccaccgctttcgccaaggatttgcttcctaaatatttcaagcacaacaacttctccagcttcgttcgccaactcaacacttatggattcagaaaagttgtacctgaccgctgggagttctcgaacgagtatttccgaagagacgagaagcggctcctctgcgaaatacagcgacggaagatcctcccggcaacgccgccgacccgagcgactgcgaccgcggcggttctatctccgctgccgctatctacgattccgccggcgaagctgatcgtgtcgccgtcgaactcagcggaggagcaggtgatttcgtctaactcgtcgccggcggagctgttggatgagaacgaccggctgaggaaggagaacattctgttaacgaaggaattggaggagatgagatcgctctgcaacaatatattcaatctcatgtcgaattacgctaacgttcaagcggacggtggttccgcgggggtggcggcgcggtgcttcggcgaggatgcggtggaggagatgaatccgaagctgtttggggtggtgattggtacgaagcgagcgagagaagagaatgatacggttttgagtctgcatcagccgttccatgcggacgtgaaatccgaagcgttggatttcgcaagacgtggcgaaaataaaaaaacgccgtggctaaatcaatgtcatagagcaaatcagagagtgtgtaattgacacacgacgttgtaacagcagctaggaacacgttaggttaagctaggggcgtcgcagagaatcagagtcctgagcacggagacgcgcgtggcaaatgtacgtcgttaaccgtttgggactttttttcgtagaagcttctcagaagaaaacgatactttcgcgttcatttccttttgatgtttctattttttatttttttaagttaagggcatatattggacttggcatgtatatttgccttggaaggg

SEQ ID NO: 7900 - DNA, 1785 bp, Glycine max
gaaggaaccacaagtggacagcccagtccccatctcctcgttctcggatgaggacgaggagatcgtacaagccgtagtgtcgggctccatcccatcctactcactcgagtcgcggctcggcgacacacgccgggccacggccatcaggcatgaggtggtgcagaggctgacttcccgatccctgtcaggtttacccctggaaggtttcaactacgactcaatattggggcagtgctgtgagatgccgatagggttcgtgcagatccccgtgggagtagcgggaccactgttgttggacgggaaggagtacaccgtgcccatggccaccactgaagggtgtctcgttgcgagcaccaacagagggtgcaaagctatccacgtctccggtggggcctcctcggtgttgctcagagatggcatgaccagagcacccgttgttcggttaccctccgctcagcgcgccgcgcagttgaagttcttcttggaggatcctctcaacttcgattcgcttgctgtcgttttcaataagtcaagcagatttgccaggttgcagaacattcagtgtgctattgcgggcaagaatctgtacatgagattccgatgcagcactggtgatgccatggggatgaacatggtgtcaaaaggtgttcaaaatgttcttgattttcttcaggatgacttccctgatatggatgttattggaatctctggcaatttctgttcggacaagaaagccgcagccgtgaattggattgaagggcgtggcaagtctgtggtgtgtgaggccataattaaggaggatgttgtgaagaaggtgttgaaaaccagtgtggaggccctggtcgaacttaatatgctcaaaaaccttacgggctcagccatggctggtgctcttggtgggttcaatgctcatgctagcaatattgtgtctgctatctacattgccactggtcaggatcctgcccagaatgtggagagttctcactgcatcaccatgatggaagctatcaatgatggcaaggaccttcacgtttcggtgaccatgccctccattgaggttggtactgttggaggcggcacacaactcgcatctcagtcagcatgtcttaatttacttggtgtcaagggtgccaataaagaatctcccggtgcaaattctaggctactggccaccattgtagccggttcagtcctagctggggaactatcactcatgtctgcaattgcagctggacaacttgttaagagccacatgaaatacaacagatctagcagggatatatctacaattgtccaatgagctggccaaagtacaattaacttgtgttagagactaataagcgaatcatcagataacgacaaaaataactaaaaaaattggtattgatggtgggagggggtaaaataaagtgatgattggcatcttccatgagcaaatccagctccccagaagcatgtggttggttggttggcattcattgaatattggcttcgcatgaggcattttctgttatggagattgtacagagggacttgaattagagggtggaggtaaacaggagcctcacttttgggattagagttctctttgttttccaaaaaagggaaaatcagtttgtgtgttgtgttatcctcttgtttaaggcttactgcttcagtgatgtggtattttggcgtgttgtatttttatgtgttgtaatctccatcttgttaatttgtaattgtagcaagagatgtctcccattgggatgtagagttgttaataatagtttctggttgctcagc

SEQ ID NO: 7901 - DNA, 2386 bp, Glycine max
tctgtatctatctatccttctcttaaaaccgcagtgtctgagacgagcgagccactatgacccgccgcgacttcgatctccggcaatctaactaaaacggcggcgtatagcgggatctgcgagcatggagggtgagaacgcgagcaaggtgatcgaattggtgaacgagatagccagcatctccgagtacaggcctccggtgaagaagcagtactgcaacttggcgcggaggctgaagcttctgatcccgatgttcgaggagattagggacatgaacaaagacgcgcttcccgaggacacttccaacgccgtcctcgccttcaaggaagctctccaatccgctagggaactcctcagattcggaagcgaaggcagcaagctttacttggtccttgagcgggacgatattatgaataagttctacgaggtgacagctcagttggaacagtcattgggtggtatttcccatgataaacttgatatatcagatgaagttaaagagcaggttgagttggttcttgcccagttcagaagagctaaagggagggttgatgaaccagatgtcaggttgtatgaggatatgttgtctgtttacaacagcagcagtgatgcagctacagatccatctgttctaagtcaattagctgaaaaattgcaattgatgggaatagctgatcttactcaagaatcacttgctttgcatgagatggtggcatcaagtggtggggatccaggagcacgcattgagaaaatgtcaatgttattgaagaagataaaggatttcgtgcaaatagaaaatctagtcaaggatgataatttaggaggaaaaggcattttctcaaaagtctatggacttgggacaaatgaaaagagtcatcaggctcctgttatccctgatgattttcgatgtccgatttccctggaattaatgaaggaccctgtcattgtttcaacaggacagacttatgagcgtacttgtattgagaagtggttgcaagcagggcacgggacctgccccaaaacacagcagactctcactagtactgttctcacacctaactatgtattacggagcctcatagcacaatggtgtgaagccaatggcatagagccaccaaaacgacctagcgattcacaacctagtaaatcagcatcagcctactctcctgctgagcaaagtaagattgaaagtcttctccaaaagctcacatctgtgagtcctgaagaccagagatcagctgctggcgagatccgccttcttgcaaagcgcaacgcagataaccgcgttgccattgctgaagctggtgcaatacctctccttgttggtcttttgtctgtgcctgactcccgcactcaagaacatgccgtgacagcgctcctgaatctttccatatatgaaaacaacaaaggaagtattgtttcttcaggagcagttccaggtatagttcatgtgctgaagaagggaagcatggaggctcgggaaaatgcagcagcaacacttttcagcctttcagtaatagatgaaaacaaggttacaattggatctttaggagccataccaccactagtgacactgctaagtgagggtaaccaaaggggtaagaaagatgctgcaacagcactcttcaatttgtgcatttatcagggcaacaagggaaaggcagtgagggctggcgttattcccacgctgatgcgactactgactgaacctagcgggggaatggtggatgaagcattagctattttggcaatattggctagccatcctgaagggaaggctactattagagcttcagaggcagtgccggttttagtagagtttattgggaatggctcaccaaggaacaaagagaatgcagctgccgttttagttcacctctgttctggagatcaacaatatcttgcacaggcacaagagctgggggtgatgggtccactgttagaattggctcaaaatggtacagacagaggcaaaagaaaggctggacaattgctagaacgtatgagcaggttagttgagcaacagcaggaagttccaatacaaactgaaactcaagctcagaacgaggatacccaaccacctttgattactaaccccgatgattcctaagatgtcttattatactttgttcattttgtctttttgttctctttaaagtgttgaaagaagcatctgtttggaggaaagggtggaagatcaccttcctactccataagttatttgtttgtttgtgtgatattcagcagagatgtaatgcaaaaaacttgtgaaagtgggcaagaagaaatcgaagcaaatgggcaagcttgaagtggaaaatgtataatttgtaacatgcactgtattctaatcatcctcagattttaatgaagagatgttttgttt

SEQ ID NO: 7902 - DNA, 1294 bp, Glycine max
cttttatttcactccatgatcatcactcacacatcaaacactactactagctccttgtatgagtgtcattccttctagctaaatctctctcttttggggtatggaattcaacaagttcagaatcagaagctatgaggggcaatctgatagggctcaagtggaagatcttgagagaagatgcgaggtagggccatcagaaagcgtgtttctcttcacagacactatgggtgaccccatttgtaggatccggaacagtcccatgtacatgatgctggtggcagagttggacaatgaattggttggtgtcattcaagggtctataaaagtggtcacagttcatggtcaccctccaaaggatttggcaaaggtggggtacgtccttggcctaagggtatcacctcagcacaggagaaaagggattggctcaagccttgtgagaacactagaagaatggttcacttcaaaagatgtggactatgcatacatggcaacagagaaagacaaccatgcctcagtgagtctcttcatggacaagtttggctacaccaagttcaggactccagctattcttgtcaaccctgtgaaccatcattgctttcaaatatcacccaacattgagatagcaaggttgaagattgaccaagctgagtacctctatagaagattcatggggtccacagagttcttccctaatgacatagggaatatacttaggaacaagctaagtttggggacatgggtggcatatttcaaaggagatattgcttggggtgattttgggtcagatggacaagtaccaaatagttgggctatgcttagtgtatggaatagtggggagatattcaagttaaggctagggaaagcacctttttcttgcttggtatgcactaagagttggtggttgattcataagatcttcccatgtttgaaattgccaaccatacctgatttcttcaacccatttgggttctatttcatgtatggggtgcaccatgaagggccattttcagggaagctagtgagggccttgtgccaatttgtgcacaacatgggtgctgagtccaaggatgagagtaattgcaggatcattgtgactgaagttggaggaagagatgagctcaaccaccatatcccacattggaaattgctctcatgcccggaggacttgtggtgcataaaggcgttgaaaaatgaagggacaaataacaagttccatgaattaacaaccaaaacccccccaacaagagctctttttgtagacccaagagaggtttaaagcatgcatgttttcccc

SEQ ID NO: 7903 - DNA, 719 bp, Glycine max
gttgttttgtgtgacagacaacagaggaacactcccaaacaaaccatggacgtgggtcagatgcagagacagtggatcgactacaccaaatccctcttcctcgagggcttcctggatggtcagtttctgcaacttcagcagcttcaggatgagaacaaccctgactttgtggtcgaagttgtctctctcttctttgaagattctgaaaggcttctcaaagatctcacctttgccctagatcagaatggcgttgacttcaaaaaagttgatgctcatgtgcaccagttaaagggtagcagttcaagcataggtgcacaaagggtgaaaaatgcctgcattgctttccgcaacttctgtgaggagcagaacacagatgcgtgcgtcagatgtctgcaacaagtgaaacaagagtactgccttgtcaagaataagcttgaaacaatgttcaggcttgagcaacagattgtggcagctggtgggtcaatccctacggaactgagtttcagtggatgatgggtgggtttgtagagatgcttgtattatgatcctcttctttgttaaagattatcctttatcttatttagtccatggtgaatgtatgggtttttatgaagatagaagttttccatccaatgtacctttttcttcaccaaaaagctcttcatagtttgtaatcttttgcatgctttactgaaggatgatagtagcaccattaattg

SEQ ID NO: 7904 - DNA, 1427 bp, Glycine max
ggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaaggaagaattattgtttttgctgttgaagatggaaaactacagctaattgccgagaaagagacaaaaggagctgtttattgcttgaatgcatttaatggtaaattgcttgcagctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactgattttatattaatctgtgtagcttcgttgtttgtttgttttttttttcttatttaatattgttcttccttttttttttgaggggttgggtgggggttaaaataacattatatgcttgtattttctccccgctttttaccttctgtttgcattttacaatacatggatcacaaatggtgtatgaaatggatgtcatgttctaagtttctattt

SEQ ID NO: 7905 - DNA, 1080 bp, Glycine max
attgagtcttggcgtggccaaagtagcagaaaataaaagtttcaaaggaagcctgatgggaattagcattggcacagtaacacaagccggaacagtcactagcacacagaaaatatggaggagtttacaagctctcggggcaatggcctttgcatactccttttccattatcctcatcgaaattcaggacaccataaaatctcctcctgcagagcacaagaccatgagaaaggccacaactttgagcatcgcagttactacagtgttctatttactctgtggatgcatgggttatgcagccttcggagataatgcacctggaaacctcttgactggttttgggttctataacccttactggcttctggacattgccaaccttgcaattgttatccacctagttggggcataccaggttttttcccagcccttatttgcatttgtggaaaaatggagtgcacgtaaatggccaaagagcaattttgtcaccgcagaatatgatatacccattccctgctttggtgtgtaccaactcaacttcttccgcttagtatggaggaccatttttgtgctgttgacgaccctcatagccatgctcatgccttttttcaacgatgtggttggaatacttggcgcttttgggttctggcccttgacagtttatttccctattgacatgtatatttcgcaaaagaagattggacgatggaccagtcgctggcttggacttcagttacttagtgccagttgcctcatcatttcattgttagctgcagttggttccatggcaggggtggttttggacctcaagacttacaagccatttaaaactagttattaaatcaaggccgtaagaaatagctagaagtgtttgaacatatgatatttttatacaaaactaatgataagttagtttgtgaaattaaagtatatacgttccatgcctgctgctgttagagcaacttgatttgaggaaaaaagtgataattggacataatatacctcagatttggacgtatacagtctgtgtatgtgtgttattttacaaggaataaaagtctttgaacgtgttatttcttt

SEQ ID NO: 7906 - DNA, 806 bp, Glycine max
aaatgttcccagatagtgattttctgaacaaagaaattgaaattccaatccctggtttccatccctacaggctcaacctcttcaggttggtttggaggacaatatatgtaatgttgagcactgtaatatcaatgctcctcccattcttcaatgacataggtggacttcttggagcatttggattttggccccttacagtgtatttcccagtggagatgtacattattcaaaagagaataccaaagtggagcacaaagtggatctgcctccaaatacttagcatgacttgccttttgatgactataggagctgcagctggctctattgctgggattgccattgatcttcgaacttacaagccattcaagaccaactattgattaaactatgattgccattgatagagatttcagaaaccaaatttcatttcttggtcatattcttatgaagccaaggatatatggtgatcttgtttgtttatggcctagcagccctgtgtgttccacttctttctactgtgtatctgttactctctagctcgttctgcaacctaattcaaaatggaagaaatgaagtaaaagcatataaatctagtgtaattataatcatattttcattttttcccttctgttttacttttatttaagaataaaatatgttttttttataccaatataggtctagttggtaaggaacaaattcatgttccaaaattatgagtttggttcccactatccatgtaggaatcttattaggagtcatttgtgttctttgaatgaaatctgtcctgaggtagtacattctcg

SEQ ID NO: 7907 - DNA, 1668 bp, Glycine max
cgctttattgcatctcagaggccaattctttcgccgcttcttctctctttccaacgcttccccctgtggtgttctcgtgttgctggtaacaatatggttgttgacgctttgaatgaggatttgagaatcaacggagcagttgaaccgttgcctgaggactttgatgcaacagctgtaatcatagatcccgtgcctttggcagttgtagacaatggcattgtcaaggaggaggcgcagatcattaaaggaaaagagaaaagagaaatagtactgggaagaaatattcatacctcgtgtctagaagtcacagagcccgaggcagatgatgaggtcactggggaccgggaagctcatatggcaagtgtgttggccagatacaaaagagctttgactgaaaggacaaagcatcatttagggtacccctataatttggatttcgattatggtgcgctcacgcaacttcagcacttttccataaacaaccttggagatccatttattgaaagcaactatggtgtccactcccggcagtttgaagttggtgttttggattggtttgcccgattgtgggaactggagaaaaatgagtactggggctatataacaaactgtggtacagaaggcaatctccatggcatcctagttgggagagaggtctttccagatgggattttgtatgcttcacgggagtcacattattctgtgtttaaagctgctcgaatgtacagaatggaatgtgagaaggttgatactctttggtctggggaaattgattgtgatgatttcaaggccaagcttcttagtcaccaggataagccagcaattataaatgtgaacataggtacaactgtgaaaggggctgtggatgatcttgatctggtcataaaaaaacttgaagaagctggattttcgcatgacagattctacatccattgtgatggggctttgtttggtctcatgatgcctttcgtgaaacgagctccaaaagttacttttaagaagcctgttggcagtgttagtgtttctggccacaaatttgtagggtgtcccatgccttgtggtgtgcagataacaagattggaatatgtaaatgctcttgccagggatgtggaataccttgcttctagggatgccacaatcatgggtagtcggaatggccatgctcccatattcctctggtataccttgaatcggaaaggatatagaggttttcagaaagaagtacagaaatgcttgcgaaatgcacactacttcaaaggccgccttgttgaggctgggattggtgcaatgcttaatgaactgagcagcacggttgtgtttgagaggccacatgatgaggaatttatacgcaagtggcagttagcatgcaaggggaatatcgcacatgtggtggtgatgccaaacatcactattgagaagcttgatgattttctgaacgagcttctggagaagcgtgctacctggtttcaagatggcaaggatcaaccctactgtatatcatcagacgtaggtgaaaagaattgcctttgtgctttgcacaagtaattgcagcatcccatctagtgtttattgctgtagttggtttttggagtgtttatccagtgtacgtcactatgttctatcaggactttgatgcaattaataacatttagaatcttctttgctgtc

SEQ ID NO: 7908 - DNA, 1570 bp, Glycine max
cgctcttcaacaattgaaaatagttcaccctgccgccccaacccaacatcgtctttctctctccaatatctctaccctaatccaccctttctgaacaaaaataaaaaaataaaaaaaaacccatcgatttcttggacctccatgacttctttgtctacccatcacacctatagccgaaagcaaaaatctctcggcctcctctgcaccaattttctgagtttgtacaacaaagaaggtgtgcgcctggtcggtctcgatgacgcagcttcgcggttaggtgtagaaagacgtcggatctacgacatcgttaatgttttagagagtgtcggtgtgctaaccagaaaagctaagaatcagtatacttggaaaggattttgtgcaattcctgctgccttacaagaacttaaggatgaaggtttgaaggagaatcctggatcatttgatgactccaatgacaatgcaaaagtgtctgatgatgaggaggaggaagaagaaacatttcctaatattaacattgggagtcagagtgagaaggaaaatcctgattacactgctactgtcaaatcctccaagaatgaaaacagaagggaaaaatctctggcattgcttactcagaattttgtcaagctttttgtctgctctaattttgaaatgatctcccttgacgaagctgcaaagttgttgcttggaaatgccaacaatagaacaaaagtcagacgtctatatgatattgcgaatgtgttatcctccatgaacctaatcgagaagacccatacaacaaacacaagaaaaccagcattcaggtggttgggtgtgaggggaaaaacatggggtggatcagttgacttggctcaaaattcaaatgtcaaagagtcacggaaaaggatgtttggaactgacattggaaacataagttttaaaaggaacaaagttgatttgtccatggatggccagaattctaaaatgcaaaatcaacacgaaaatattagtccacgagctcagttagagaaaatcatcataaaaaaagatgctaagcagacttcagagagctatcagtttggcccttttgctccagcttatgtgcccaaagttggaacctctgaaaataatagtgtgaaaaaggtgcatgactgggtacagcctcgcacaggagcatcgtcctcaatatcaaaaccaagctttaaaagatctattttcccactacatggtaagcatggtaaatcttggtactctgaagctgctggggaaaaagtcaacgaaaactttataattgacttgtccaaagtcagtccagataattgtagcttttctagaaaataaatgatccattactgagtgtatgttccacatatgttggcatattctcaaaatgaaatgatccattactgaatgcatgttctccatgcgttactgtattctcaaaagaaaatgatccattgttgaatccatgttctccaggggttagcgtacagctaccctgtgctgatttattaaccgtcacatgtcatgttaaaggatcagttaacagttcttatagattatttatcatgtttattataaggttatgatt

SEQ ID NO: 7909 - DNA, 1693 bp, Glycine max
ttgctttctaattattcgtgttgtcagtgtctctttgaggccattttgctagctatttaataatggcaattgagaagcatgaggatgttgagagtggatatttgcacgagcccttcattcaaccagaggatgctgctgctgcttgtaaagaaaatggatcagataagagtgtgaaaaatggatccattggaatggttttgcttagcacacttgttgctgtttgtggttctttcacatttggaacttgtgtgggctattcagcacccactcaagcggctatcagggcagatcttaatctctctcttgctgagttttccatgtttggttcattagtgaccattggtgcaatgcttggagctataaccagcggcaggattacagatttcattggccgcaaaggggcaatgaggatttcaacaggattttgcattacaggatggatagctgtcttcttctctaagggttcttactcccttgacttcggaagatttttcacaggttacggcattggagttatctcatacgtggttcctgtatatatagcagaaatagcacccaaaaatcttcgaggaggactagcaacaacaaatcagcttttgattgttactggagggtcagtctcattcttattaggaagtgttataaattggagagaacttgcattagcggggctagtgccttgcatttgcttgctggttggtttgtgctttatccctgagtcccccagatggctggctaaggttggccgtgaaaaagaatttcaactagctttaagtagacttcggggtaaagatgctgatatttctgatgaagctgctgaaattctggattatattgaaactcttcaaagtcttcctaagactaagctgttggatttgttccaaagcaaatatgtgcactctgtagttattggggtcggcttaatggcatgtcaacaatctgttggaattaatggcataggattctacacagctgagatttttgtagcagctggactttcttcaggaaaagctggtaccatagcatatgcttgtatacagattccatttacattattgggagccattttgatggacaagtctggaagaagacctcttgtaatggtttccgcagctgggacattcttaggttgctttgttgctgcctttgctttctttctcaaggaccaaagcttattgcctgagtgggtacctatattagcatttgctggcgttctgatctacatagcagcattttcaattgggctcggatcagttccatgggtgataatgtctgagatatttcccatacatttgaaggggactgctggaagcttggtggttttggtggcttggctaggagcttgggtagtttcatatactttcaactttcttatgagctggagttctcctggtacattgtttttgtatgctggatgttccctcttaactattctatttgtagcaaaattagtcccagaaaccaaaggaaaaactttggaagagatccaggcttgtattagttcatagagataaaagatcaaaaacgcactgcaggacccagtcaaaccattaccaccatttttcaaattcttttacatccatttaggaccgtcaaggcataaaataacataatgttgccatatcgatccatttttgttgttgtataataataataataataataataatgtatcattagcttatttgataag

SEQ ID NO: 7910 - DNA, 939 bp, Glycine max
gccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattat

SEQ ID NO: 7911 - DNA, 1776 bp, Glycine max
ctcttggtcctttctctaatccaaatatctctccgttaatgctctcaccacaaacttcaatagactagccaaaagctaacaccaactataggccaaatcaccaataaatattatttcccgttcttttggcgtgttggccacccactgaacacatttgcactcacacatagaagcagagagaggccattggttggtttcagagatgggaagcatgcacatagaaaccccagaaacttttgctgatggtagcaaaaacttcgatgatgatggacgagctaaaagaactgggacttggattactgcaagtgctcatatcataacggctgtgattggttctggagtgctatctcttgcatgggcaattgcacagatgggttgggtagctggtcctgcagtgctctttgtcttctctttgataacatacttcacctccactcttctcgctgactgttaccgttcacctgaccctgtacatggcaagcgaaactacacatattctgaggttgtcaaagccaacctaggaggaagaaaatttcagctgtgtggattggctcagtatataaatcttgttggtgtaacaatcggctacactataactgcatcacttagtatgggggcggtgaagaagtcgaactgtttacacaaacatggccatcaagacgagtgcaaagttaaggacaacgcttttatgattgcttttgcctgcatccaaattcttctaagccaaataccaaacttccataagctctcttggctctctatcgtagcagctgttatgtcttttgcttattcttccattgggcttggcctttccatagccaaaatcataggtgggggacacgtgcgaacaaccttaacaggggtggaagtttcgggaacggaaaaggtttggaaaatgtttcaagctatcggtgacattgcctttgcttatgctttttctaatgtcctaattgagatccaggacacactgaaatcaagcccacctgagaacaaagtcatgaagagagcaagtttgattggcattatgactacaacattgttttatgtactatgtgggtgcttaggctatgctgcatttggaaatgatgcaccatctaatttcctcacaggattcggcttctatgagcccttttggctaatagactttgccaatgtctgcatagcagtgcacttagttggggcataccaggtctttgtccaacctatatttgggtttgtggaaaagtggagcaaagaaaattggacagaaagccaatttataaatggcgagcatactttgaacattcctctatgtggaagctacaatgtgaacttctttagggtagtgtggaggactgcatatgtgattatcactgccgttgtagctatgttactcccattcttcaatgactttttggcccttattggtgcactctctttctggccattgacggtttacttccctatagagatgtacattaagaagtcaaatatgcaaagattttccttcacctggacttggctcaagatattgagttgggtttgcttgatcatttctattatctcacttgtgggttccatccaaggcctttcggttagtatcaagaaatacaagcccttccaagcagaacaatagaactttcatacttagtattccaacttgagccaagagtttctattgagggcgacaaaatttgtattactatgttttgaaatagttgttatattttcaattctcgaaatcgagacaacttgttatactaaagtaatataataaaatgtttagtttgctatgtt

SEQ ID NO: 7912 - DNA, 2245 bp, Glycine max
ctaaatctctcacatctcttatctttctctctctctcttataatacaagaccctagtcctctctcacgccccaaccaccgccatcaccaaaccttcctctctcgatttcccttcaattcccttctgggctttgcaattcggccaattgggtccccaaatctgcaaccttttcctctgtctaacgcgaaacggaagagaaacacccacatagagaaagagaaaaaaaaggagaggaagaaacaattttagggtgtggggttaaaacccggggttgaagcattgcagacatcacggctattcaaggagttcgccactctctttctcatgcccgttgtgtccgacgcaagggttgtgtgacggagagcaatccttcgccgcacggcgggcgtggcgctctgccttccgaaggtggcagcccctccgacctcctcttcctcgctggcggtggttcttcccattaacattctaaagtagtattagccattaacattacatcctacaccttcaaaagttctctctattagcggtttctggtttcttttgttcttcttctttggtagttgttaggtttggtgaggtctaagatgttgagcattaagagggttcccactgtggtttcaaattatcaaaaagaagagacaggggaggctgctgccggaggttgtggtcgtaactgcctcaaaagttgttgcattcaaggtgcgagactgcctttgtatgctttcaagaaggtggacaaggtttgtggaaatgaattgcctttgcttggatgcaaggagcagcaccctgtggcctttctggactcgcttgttcttggagagtgggaagatcgcatgcagagagggcttttccgctatgacgttacagcctgtgaaaccaaggtgattcctggggagtatggtttcattgctcagctgaatgagggtcgccacctcaagaagagaccaactgagtttcgtgttgataaggtcctccagccctttgatgaaaacaagtttaacttcactaaagttgggcaagaagaggtcctgtttcagcttgaggctagcaatgatggggaggctcaattctttccaaatgcacctattgatgttgagaattctcctagttttgttgccatcaatgtgagtcctattgaatatgggcatgtgctgctgattccacggatttttaagtgtttacctcaaaggattgaccatgcaagcttcttgcttgcacttcaaatggcagttgaagcaaggaatccatattttaggttgggttacaacagcttgggtgcatttgcaaccattaaccatctccactttcaggcatattacttggctcttccttttccaattgagaaggcccctactaagaaaattgccaagttaagcggtggtgtgataatatctaaactgttaaactatccagtcagaggccttgtctttgagggcggtcatacactagaggatttagcaaatgctgtttcagaagcctgcatctgccttcagcacaacaacataccttacaatgtacttatttcagattgtggaaggcaaatatttctcttaccacagtgctatgcagagaaacaagcccttggagaagtgagtcctgagcttctggagacccaagtgaatcctgctgtgtgggaaattagtgggcacatggtgctgaagaggaagaaggactatgaggaggcatctgaagccaatgcttggaggcttcttgctgaggtttccctctctgaagagaggcttctagaagtcactgctcttgtttttcaagccattacatcatcggttgagatgaatgtcaagcctcaacgtcttgaggaagttgatgccgttagcccaaacgcacagcatgccatggtggctggttcacatgaatgccttgttctccagtaacaaggctatgaacaaattcgtagtgattatgaactaaatattgcttgccatgttacgtttcagttctaataagtgtagtaccttatattatggtccagttactggagtctgaagtatttatgttttaaggacttgaataattgtggtttgtattttattatatggactcgctgtacggtgcttgattgtccttcgtggtctatgtaaaaatacaatgactgttcttctgagccttattcagtggttagtgtttctgtgtttgtggtttgattaatgtgacatactttcatatagtgaggcatgggaatgtgcaagtagcatttatataaatggtgcttgatctttttctattt

SEQ ID NO: 7913 - DNA, 1570 bp, Glycine max
tttccacatatctgacagaaaaaaatggagaactatcagtacccggcgtcgtaccctgactccggcgagtcctccccgcgctcgcgcgagatcgacttcgagaacccgccgccgtgggacgagcagcagaaccaaaactacaaggccaagttcatgtgcagctacggcggcaagatccagccccgcacccacgacaatcagctctcctacgtcggcggcgacaccaagatcctcgccgtcgaccgctccgttaagttctccgccttcctctccaagctctccgccctctgcgactccccgccacaggacctcaccttcaagtaccagctccccggcgaagacctcgacgccctcatctccgtcaccaacgacgacgacctcgaacacatgatgcacgaatacgacagactctatcgccctaacctaaaacctgttagaatgagactcttccttttcacactctctaattcaaaccctaattcctctttctcctccgaacgcgaccgtttcgttgaggctcttaattcgggtccggttccttctcaacccgatccgatcaaaaccccacccgttacgccttctaatgttgattatctcttcggtctcgataaagccgttgctcctccaaatcttcctccgaacttcgcagcggttaaattccacgatccggtgccggaacctgtcgctccgacgccggtagagtatcaatcgagagtttccgatcgggttgttggatcggatccgaatgtgaattcgatggaaattcagagacagatgcagcaggagatgcagcgattgcagattgcggagaatgaatatcgtagaaggagtgaggatggatttgcaactggttatgctgctgcagccggaggagattattacatgcagaaggtgcaggagaaggttccgccgcagaatgcggcggtgccgcctccggcggcgtactggtcggagaagcagttttccggggagggatatcagacgacggtgacgacggcggctccgggaggaggtgaccagccgatgtatgttatggcggcgccggggacgttctatcaccactcgccggtgatgcgacctccggcggcggcgcagggatactacgctgtgcagaggatgggttctgatggctaccgtgaacagcaggcggtgtacggaggcatggctgcgccgaaagcggggttttcgacggcggggatggttaaggggccggcgtattcggagggatatagtggcggcgtggtgaggccggcggggttgccggataatgcggcgtatgcgcaggtggcgtatgatagcgcgagtgggagacaggtttactatactgcgcagggaggagtggtgcacgcgccgccgcagtaccaggggggtccgcctcaggatgtgaggccgggtggggtttcggtggggcaggatggtaaggtggttaacaaggttaaccaaggttctgtgtgattataatagctgtgattgagattgtcattatgttaattttgaaataaataatacactaaatatgttttgctttttttttcatggtttatatataataccaatattgttagcttat

SEQ ID NO: 7914 - DNA, 2023 bp, Glycine max
agtgatttgatttgcatcaatatggatcactaaccttgctggtggctggtgcatacaatagtatttgtaccaaacctcttttttcttttgggcacgtgtattgttttttatttatgaacccaactccatccatcattgttgggacgaactcaacaagctagatcagtagtatatatcatcaaattcaatagtctcttctccatttaatagatggttgaaaaatcttccagaaccaaccttggccaccatcaagattttggcatggaggcttactccatagatggtgtttcttcacaaagtgagtccaaattctacgatgatgatggtcatgttaaacgaacagggaacgtttggactacaagctcgcacataataacagcagtggtgggttctggggtgctgtctttggcatgggccatggctcaaatgggttgggttgctgggcctgtagttatgatcttcttcagtgctgttacgttgtatacgacgtcgcttctggctgattgttatcggtgcggtgaccccgttacggggaagagaaactatactttcatggatgcagttcaatccattcttggcgggtattatgatacgttttgtggggtagttcagtactcaaatctttacggaaccgctgtaggatacacaattgcagcttctattagcatgatggcgataaaaaggtccaactgtttccattcttcaggcgtaaaaaatccatgtcacgtttcaagcaacccatacatgatcggttttggcataatccaaattttattttctcaaattccagattttcataaaacatggtggctctccatagttgcagcaatcatgtcatttgcctattccacaattggcctcgctcttggaattgctaaagttgcagaaacgggtactttcaagggtagtctcacaggagtaaggattggaactgtgactgaggccacaaaagtatggggggttttccaaggtcttggtgacatagcctttgcctactcatattctcaaatcctcattgaaattcaggacaccataaaatcaccaccatctgaagcaaagacaatgaagaagtctgctaagataagtattggagtaaccacaacattttatatgctttgtggcttcatgggctatgctgcttttggagattcagctcctgggaacctgctcacaggatttggtttttttaacccatattggctcatagatattgccaatgctgctatcgtaattcaccttgtgggagcataccaagtttatgcccagccactctttgcctttgtggagaaatgggcttcaaaaagatggcccgaagttgacacggaatacaaagttccaattcctggtttttcaccttacaatctaagcccatttagattagtttggagaacggtgtttgttatcataaccactattgtagcaatgttaattccattcttcaatgacgttttgggacttcttggagcactggggttttggcctttaagtgtttttctcccagtgcagatgagtatcaaacaaaagaggacccctaggtggagtagtagatggattggtatgcaaatcttaagtgttgtttgtctcatagtatcagttgcagctgctgttggctcagttgccagtatcgtgcttgacctacagaaatacaaaccgtttcatgtagactattaaaccccatccacgccctccctagcaaagggtaaaaactgatgtgggcaatgatggttgtttgtatatcttttgtttagatctgagattggagccgaaggtattccaaaaaacagaaaccatgggactaatctcctgaaaaagtaaagtattaattaagggacaatatctttaccttacaggtgctgctctatgcacataatcattgatcaaacccctatcatcacatggttaaagaacccaaactatttgtcacttgtgacacaccttatgattgtttgtatatcttttatttcatgagcaatgttatttcagtgccacccttattacaatcttcaagcattgaattgaaatt

SEQ ID NO: 7915 - DNA, 1492 bp, Glycine max
caaagactgaaggcaaaaaaaacagagaaaggtctggctctgaatgatggatagaaggcactgttacaaggatttgctgccattggtggtgcttgttgccaatgaatgcaacaacacaggcttgttcactctcttcaaagcagccacactgcaagggatgagtaactatgtctttgtcacctatgcctattctgttgcctttcttgtactacttcctgtcacttttttctacagaagatcaagagtggttcctccactcactttttccatcctatccaaaattgcccttcttggagtgatagggtgttcatctcagatcttggggtatgctggcatcaggtatagttctcccacactttcctctgcaatcagcaacctcactcctgctttcaccttcgtgcttgcagtcatttgcaggatggaaaagatagctgtaaaacgtagaacaacccaagctaagatattgggcagcataatatcagtattaggtgcatttgttgtgactttctacaaaggccaatcggtcatcatagctgataattccccttccattcaacttccacaatcaaatggcattcttacttcagtggatagaaattgggtcattggtggccttctgctcacagcttgcaatatactacttactgtatggttcgtttaccaggttgaaatcttgaaggagttcccggatgaactatctatggtcttcttttacaacttgtgtgcagccattgtagcatcaattgtaggcttattaggggagaaaaattcaagtgcatggaaaataagaccagatatatcactgatctctattgtttgcactggaatatttaacaagttcctgagtagtgcaatatatgcttggggaatacacttaaaagggcctgtgtatgtagcaatgttcaagcctctctcaattgttattgcggttgccatgggtgttatgttccttggtgattctctatatgttggaagtataattggagccacaataatatcaattgggttttatactgttatgtggggcaaagcaactgaacagaaggaagaggagggggaggaggaaaatgttggtagccaggaatcatcaattactgagaacgttcctcttttgcaaagctatataactgtaaattctacgaagaaaatagatggaagtgtatagacagctgaaatgagaagtttcctcttctgcaaaaccaaaaaatttgtaaattctgaatagaagacaggtggaagtgtatagaagacaaatataaactgtttgcacctctttagtcttgacattgtagaaaatcatagagaccattttttgtcacagaacagcacattgtaactttcagtaatttatgaaaatacaattctcccatacttactataggttctagttgcagaagcagcctagacaatgggagcatcatgtacctttatacttcagatacaatagtcaatatttctaaggaatgaagccccaaagaagtatcataagttc

SEQ ID NO: 7916 - DNA, 1249 bp, Glycine max
gtttctatcaacactactccctccaccatgcaacactgcatgcagaatgcttccaagtatggataatacttgcccatgtatgtcggatattacgcagatcattaggaaagctctcattccatgctattgtttgtattttccttgcatcttctgtgtctccccaaatgaaagagcgacattgcacactaacacagatcttgtagcaatggcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccattatgatgctgtttagaatattaccaagatgttgttctctttagc

SEQ ID NO: 7917 - DNA, 717 bp, Glycine max
ctcactccttccccatttcaaatcttcgtctccaattcgcgctcacataaaccctaccctcaatttccattcgcaatttttgttgctgctgagcacggaatcggagatgaaagtgaagatcttgcaatggcatgctattgcttcttggacttgggatgcacaggacgaaacgtgtgggatttgtaggatggcctttgatggatgttgtcctgactgtaaacttcctggagacgactgcccgctgatttggggtgtatgcaatcatgcgtttcatttgcactgtatcctgaaatgggtgcattctcagacatcacaagcgcattgccccatgtgccgtcgtgaatggcagtttaaaggatgagagcatttttttttcctttaagggcggccactgaccaatgtaaatcggtctagttgaagacacttcttctgcagttttaccacgcatataagatgcactggcttcttattagctattgtacacttcaatatattttattggttcggtaaggaggtgatcaaattcaaagtttctggatgtgaaattttattattgtcatgtgaatgacatcctcgttttttttcttctgatagtttgctgatgtcttactgctcatattttgtatcgatagtatgcttccgaagcatgacaatgtatgtaattggcttcacaagattgacctaaataaggttgcattattgaagttattatttttt

SEQ ID NO: 7918 - DNA, 1862 bp, Glycine max
ggaaggcaagggcttgtgttgtcacaatccaaggtttgtttgtgtttgtgccactgtcctgtctttgtttatatatcttagtttcgtcggtgtttacttagatgtatgtgttgttgtagagagaagtaatggcgaacatagacatcgaagggatcttgaagcagcagcagccttatgatgggcgcgttccgaagacgaagatagtgtgtactttgggccctgcttctcgatccgtagaaatgaccgagaagcttctgagggcagggatgaacgttgctcgtttcaatttctctcatggcacccacgactatcaccaggaaaccctcaacaatctcaagactgccatgcacaacactggcatactctgtgccgtcatgcttgacactaagggacctgagattcggactggttttctgaaagatggaaaacctattcaacttaaagaagggcaagaagtcaccataactactgattatgacattaagggggatccggagatgatatccatgagttacaagaagctgcctgtccacttgaagcctggaaataccatactgtgctctgacgggacgattactctcactgtcttgtcttgtgaccctgatgctggtactgttagatgtcgttgtgaaaacactgcaacgttgggtgagagaaaaaatgttaaccttcctggtgttgtggtggatctacccacacttactgagaaggataaggaagacattcttggatggggtgtacccaacaagattgacatgattgctctttcatttgttcgtaaaggctcggatcttgttaatgtccgcaaggttctggggccacatgcaaagaatattcagttgatgtcaaaggttgagaatcaggagggagtcctgaattttgacgaaatcctgcgggagactgatgcattcatggtggcacgtggtgatcttggaatggagatcccagtagaaaagattttcctggcacagaagatgatgatatacaagtgtaatcttgttgggaagccagtggtgactgctacccaaatgcttgaatcaatgataaagtctcccaggccaacccgagctgaagcaactgatgtagctaatgcagttcttgatggaacagattgtgtgatgcttagtggtgaaagtgctgctggggcatacccagaacttgctgtgaaaatcatggctcgcatttgcattgaagcagaatcatcccttgactatggtgccatcttcaaagagatgataaggtctaccccattgcctatgagtccattggagagccttgcatcatctgctgtccgcacagcaaacaaggccaaagcaaaactcattgttgtgctgacacgtggcgggtctacagccaagttagttgccaagtataggccagcggttccaatattgtcggtggtggttccagtgttgagcacggactcatttgattggacctgcagtgatgagacgccagcaaggcacagcctgatatacaggggcttgattcctatactgggcgagggatctgcaaaggctaccgatgcagaatccacagaggtcattctcgaagctgctcttaagtccgcaacagaaagggccctttgtaagcctggtgatgcagttgttgccctgcatcgtattggagctgcctctgtcataaagatctgcatagtcaaataatgcatgctcaactcaacgtgccgccaactaatgcagggttatgttttgccttttatttctttctttctgctgtttatccgtatcataaaatggaggatttagttactagctgtagatcgagtgttttttggtatactctgtttatattgcggagtacttctaaatcagattatcatggaaataatactcttacctttt

SEQ ID NO: 7919 - DNA, 3159 bp, Glycine max
cgtttcagcaaaacctctcttcttcttctgattgattccacctcgcgatttttcgattttcgtttgttttcttctttttcggtttctgatctgaactcgattcgattcgctattgccggaaaatgagtcctccggcaagtgtccggtgatgatcgctccctcgagaggttgttgaggttatcgttgttgttcttcgaagtcatggtttcgatctgaggtgctgtcagtgctcacagcgcgacgctgttgagttgaaatttcgctggttttgagttgctttgtgactaattttttttctcggcaaccaaacaggaggattcaaaatttgcactgattaattagtaaagttttggcgctctcgagttcgttttggtgaggattctgattaaggaaaattttcttttattcattcggaggagaagcgtctcaaactctctctctttctccctcgtagcatcatcatcatcaccataccttgttcagattctgctcactttcaccacaacggctttactatttaccgcgtttcgttttcgtgtcaccgcaaataatgaaaggaggtgttccctgtatccactcctcgtcagggaagatctgaagcagtgctagctgctcacgtcctgtaatggacgcatactcctccggcgaagaagtggttgttaagactagaaaaccatatacaatcactaagcaaagggaacgatggacagaggaggagcataataggtttctagaagctttgaaactacacgggcgagcatggcagcgcatagaagagcatataggaacaaagactgccgtgcaaataaggagtcatgcacagaagttctttacaaagctggagaaagaggcccttgtaaagggtgttccaattggacaggctcttgatatagacattccccctccacggcccaaaagaaagccaaacaatccttatcctcggaagaccaggattggtaccacatcattacatagtggagcaaaggatggaaaactcaatttagttgaatcttcacatgttaatcaagcactggacttgaaaaaagaaccacttccagagaaacatgatttagacgaagggctaacaactgtaaaagaaaataaggatgagaaccacgcaaaagtatttactcttctccaggaggtaccctgttcctctgtatcttcagcaaatgagagttcaataacaatgtctgtgccactgggaaatccatgtgccttcaaggagattacaccttccgtgaaagaggtaatagcacgagatgaaaaaactgaatcttttgtcactgttgaacctgaaaatgggaagttggagatcaatgatggaaaacagactaatggcactagtaaagactccaggttagaggattctgatgctttacatatgaaattggttcaaaatgagaaaccagatggtcttgattgtgaattaacaatagatgggatgcaaggcaatcagaattaccctaggcatgttactgtgcacgttgttgatgggaaccttggaacaaatactcaaaatccatcacaagatatgttgtttcgagattccatgtttcagccaataggaggggttaacgggcaacgaaatgtttttaccaatacagctccatcgaacacaagtgaaagtcaaaataacactgcacgatcttctgttcatcaatcatttcttccttatcctcccttcacacaacacaaccaagacgattaccaatcatttcttcacatgtcttcaacattttcaaatcttattgtctctaccttgatgcaaaacccagcagctcatgctgctgcaagtttcgctgctacattttggccgtatgcaaatccagaaacttcagcaaattctcctaggtgctcccaaggaggttttacaaatagacaaattggttcccctccaagcgttgcagctattgcagctgctactgtagcagctgcaactgcatggtgggcagctcatggattgcttcctttgtgtgctcctcttcatacttcttttgcctgtcctgcatcagtgactacagttccatcaatgaataccggtgaagcaccggctctgaaggcagagcaagaaaaaactactctacaaaatcctcctcttcaagatcagatgctggatccagaatactcggaagctcaacaagctcaacattcagcttcaaagtcaccagctgccattttatcagattctgagagtggagatgccaagttaaatacttcatcaaaggttactgatcatgagacgaacaaaacaatttctgagcaccttgattccaacaaaacaaagggaagaaaaccggttgaccgttcctcatgtggttccaacacggcctctagcagcgatgtggaaactgatgcactagagaagggtgagaaagggaaggaagagcctgaaatacctgatgctaaccaattagccattgagtttagtaatcgtcgtagaagcgttagcaaccttactgattcttggaaagaggtttctgaagaggggagactggcctttcaggctctgttctccagagaggtgttgcctcaaagcttttcacctcctcatgctttgaagaatacggatcatcaaatggacaacgccaatgataacaagcaaaacatagatgacaaagatgaagatcttgacggcagcaagaaatgcagttctaattatgaagcgatgcagaaaaacctgctatttgtagaaaataacgagggactgttaaccatagggcttggacaaggaaagcttaagactcatcgaacaggttttaaaccctacaaaagatgttccatggaggccaaggaaaatagggttggagcaagcagcaatcaaggtgaagagcaaggttgtaagagaatacgtttggaaggggagacttcgacttgaggttcgatatatgcagtaacataaaggcaacctttggtttttgcatatcatttctttatccctccaacggtgtacctatattgtatgtttatttctaattctgcagctcacgaaacttgtcgtgtagatgtgtgtaccgtattaaattactgtgtacgctcttttactatctttgtatgatgttaatgctgtttaaaactccgctaaatagacttagataagaaacattaagtattgtttgagccatgaacatcaagtaatttatgatccttcattcagcc

SEQ ID NO: 7920 - DNA, 2329 bp, Glycine max
aggaactcaaatcctggccaagatattgctgaacttcaacctgcatccccaggaagccctcttttggttcctaggcaaaagtattgtgaatcattacacaaaactgtcaggagaaaaacaaacacagtgatggttggtaacgtggctattggtagcgagcatcctataagaattcagaccatgactacgactgacactaaggatgttgctgggacagttgaacaggtgatgagaatagcagataaaggagctgatattgtacggataacagttcaagggaagaaagaagctgatgcttgttttgagattaaaaacacccttgttcagaaaaattacaacataccgttggtggctgatattcattttgctccctctgttgctttgcgggtagctgaatgctttgataagattcgtgtaaaccctggaaattttgctgatagacgggctcaatttgaaacattagagtacacagaagaagactatcagaaagaacttgagcatattgaaaaggttttcacaccattggttgagaaatgtaagaaatatgggagagcaatgcgcattgggacaaaccatggaagtctttctgatcgtataatgagctactatggagactcgcctaggggaatggtagaatctgcttttgaatttgcaaggatatgccgaaagttagactatcacaattttgttttttctatgaaagcaagcaacccagttatcatggttcaggcataccgcttacttgtggctgaaatgtatgtccaaggctgggattatccattacacttgggtgttactgaagctggagaaggtgaggatgggaggatgaagtctgcaataggcattggaactcttcttcaggatggattgggtgatacaattagggtttctctcacagaaccaccagaggaggagatagacccttgcagaaggttggcaaatcttggaatgatagcttctgaactccagaagggggtggaaccttttgaagaaaagcacagacattattttgactttcagcgccgatctggtcaattgccagtgcaaaaagagggtgaggaggtggattacagaggtgtactgcaccgtgatggttctgttctcatgtcagtctccttggatcaattaaagatgccagaggtcctctacaagtcacttgctgccaaactcattgttggcatgccatttaaggatctggcaactgtagattcaattttattacgggaagttcctcctgtagatgatgctgatgctcgactagcactcaagagactgatagatattagcatgggggttataactcctttgtcagaacagctaacaaagccattacccaatgccatggttctagtaaaccttaaggaaatatcttccagagcttataagcttttgccacaaggcacacgcttggttgtgtctgtacgaggtgatgagccttatgaagaactggacattcttaaaggcattgatgctactatgcttctccatgaccttccttatacagaagacaaaattagcagagtgcatgcggccaggcggttatttgagtacctatccgacaattctctaaacttccctgttattcaccatattcagttcccaaatgggattcacagagatgacttggtaattggtgctggttctgatgctggagcccttctggtggatgggcttggagatggacttcttttggaagcgccagacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccccggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagaacatggacgatgggtggaccctcctgccgaggagtaaaagcaagagcttaattttgagattggcattcaaggccatagtaagatgagcattgtcatatccaattattgtacacatgtaatataagataacactcaatgcttaagtttgagcctagttttaagttccttttgagaaagatcccaattaaagcttgttgtgaggaaatcgacagctagaacatgtatacagataacagtgtattgctttgccccatcagccatcaataataatgagaatctctttg

SEQ ID NO: 7921 - DNA, 1239 bp, Glycine max
gcgagcgaatccctctctctatctctcacacacactttctctctctctctctctcacccagatcttgtagcaatcgcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccattatgatgctgtttagaatattaccaagatgttgttctctttagcaaacttcgtattgctcattattttaggatgcgaaggtgtgacacctttcatttgtttttattctaaagcctcggaatcataactctgatcgattttaacgtgttttttgttgtgagggttttc

SEQ ID NO: 7922 - DNA, 1519 bp, Glycine max
ttttactatcttcaatggctgattcaggctcagcctcttcttccagaatgtggtgctccatccccgaacgggttcagctgcatgcggccatgttggccctgcagtttggctatgctggctttcatgtggtctcaagagctgcccttaacatgggcattagcaaacttgttttcccagtctaccgcaacattattgcttttctcctcctccttccttttgcctacttcttggaaaagaaggagagacctgccattactttaaacttcctcttacagttctttcttctggcacttgtcgggattacagcgaaccaaggtttttacttgcttggcttggacaacacatccccaacctttgcatcagcgattcagaactctgtcccagccattacatttctcatggcagtcatactcaggatagagcaagtgaggctgaacagaaaggatgggatagcgaaggtggcgggaacgatattctgtgtggctggggcgacggtgattacactatacaagggtccaacaatatatagcccaagtccacctctacagagtgagagctcagtagtagttgagtttgggacactctcatcactgggagatgcaaaggggaagaactggacccttgggtgcctctacctcatagggcattgcttgtcctggtctgcttggcttgtgctccaagcacctgtactcaagaagtacccagctcgcctctctgtcacttcctatacatgtttctttggactcatccaattccttgtcattgctctcatcgttgaaagagatgctcaggcttggattttccaatctggtggagaagttttcactattttatatgcgggagtggtggcatctggaattgccttcgctgtacagatatggtgcattgacagaggtggccctgtgttcgttgcggtgtatcagcctgttcaaactcttgttgtcgctattatggcttcccttgctttaggcgaagagttctacttgggcgggatcataggagcagtgttgatcgttgtgggactgtactttgtcttgtggggtaaaagcgaagagagaaagtttgcaaaggaacatgctgcaattacgtctactccagagcacagtggtatcaggtcctcaagccatgccaaaacattactcactcagccacttctcccttcatctacggagaatgtctgatcaacaaaaccatatatgacttcaagctggggcaccattttctctgagagaaaaagggaaaaagaagatattaaaagaagaaaatgatacccagttatatacattattaccactttatgtcaggaagcttgtgtgtgtacgaaggggttttcatcttttttattttactttattttggttaattcacatgctttctttctaggacttttagaatgagggttttctatgggaatcattacaatgatggatgccacataaaagcgggctttaaagactgaaatcccatatgcttttatatgttgattaatggtttgatttacaaaaggagatttttaatt

SEQ ID NO: 7923 - DNA, 837 bp, Glycine max
ggaacaggcaggaggacagtctttcacgggcaaggaacggggtttatgcgttgaaagatgtccatgaaccaaccatagaagatgtcctgcttcctgggaagaacatggtggcagctggttactgtatgtatggaagctcttgcacgcttgtgttaagcactggagcaggtgttaatggtttcacccttgacccatctcttggtgagttcatcctaactcaccctaacattaagatcccaaagaaaggtaaaatttattcagtgaatgaaggaaatgccaaaaactgggatcgtcctactgctacttacgttgaaaaatgcaagtttcctgaagatggttcatcaccaaagtctctaagatatattggaagcatggtagctgatgttcatcgtacgttgctttatggaggcatctttttgtaccctgctgacaaaaaaagtccaaatggaaaacttcgtgtcctgtatgaagtcttcccaatgtcattcttgatggaacaggcaggaggacagtctttcacgggcaaggaacgggcacttgatttagttccaacgaagttgcacgagcgatctcccatattccttggtagctatgatgatgttgaggaaatcaaagctctttatgctgctgctgagggtgaacaagaatgaaattggaaaggtttcttgtatctttcgctacttacaagcgcttgttttctaattgttactagcaggtgcttataagaaaactagttatctggtcatgtatatgttaataaaattggttgatgtgcctgtcagggctatagaatttatttagataaaatacttagattaaagtatcattttgttgctg

SEQ ID NO: 7924 - DNA, 846 bp, Glycine max
aaagcaatttgcatccacaaaacttgcaagaagctgcatctcctgttttgtggatgcagcttcttgcaagtttttgaataatcccttcatgatcggttttgggatcttgcaacttttcttgtcccaaattccaaacttccatgagcttacatggctctcaactgctgcctgtatcacctcttttggttatgtattcattggcagtgggctgtgtctcttggtcgtcctctcaggaaaaggagcagcaaccagcataaccggaaccaaactacctgcagaggataaacttctgagggttttcactggattgggaaacatagctcttgcatgcacttacgctactgttatttatgatataatggacacattaaagtcccatccatcagaaaataaacaaatgaaaagggctaacgtgctaggggtcacagcaatggcaatattgttcttgctatgcagtggccttggctatgctgcttttggtgataacacacctgggaacatcttgactggatttaccgaacccttctggttggttgcactggggaacggattcatcgtaatccacatgattggagcatatcaggttcgatcattctttcactgaaacataattaagttactcatttttaattttgttcttgtaaaatatttttgtatttaatttgtaatttactgaaatatacgcttttaatccgtatcattatatttctgttcttgaataatgacttgatataacgagaccgtgttacttgtcaataatctgtttatcatgtcactgcgtaacggatattttttttgaagggtgcttactattcaatggtaaagactgaatatataattcaaaat

SEQ ID NO: 7925 - DNA, 674 bp, Glycine max
aaagcctagaatagaaaacgctgtgctgtggctgagaaggggaaaggcgcggttgaaagattgaaagctcgacatgtcagggaaaggcgcaaagggtttgataactgctaaggacaaagataagaaaaaaccaatttctcgctcctcaagagccggtcttcagtttcctgttggacgcattcatcgtcttctgaagtcaagggtgacagcacatggaagagttggggcaacagctgcagtttattctgctgccatcctggagtatttaactgcagaggtgttggagttggctggcaatgcgagcaaggatctgaaggtgaagcgtattaccccaagacatctacagcttgccatccgtggagatgaagaacttgataccctcatcaaaggaacaatagctggtggaggtgttattcctcatatccacaagtcccttatcaacaaatcttcgaaggaatgaggaaggtttataacttataagttatttgaatcaaagatgaaaatcactgtaaatttaattatatcttttacctgtggataatttgccccttgcattattagtttggttgaactagaaccatccttcaaaagaaatctgaaaatttctgatttcttcatttgaattttgtgaactgatgtgctgacttttgtgctatggtactgcatgttagatg

SEQ ID NO: 7926 - DNA, 864 bp, Glycine max; identical to SEQ ID NO: 233

SEQ ID NO: 7927 - DNA, 1378 bp, Glycine max
ctcctaacaatttctctctgtttccttcttcaccgcatcaatggagttggacggcgttctcctcggcatgtgcaaccctctcctcgacatctctgccgtcgtcgacgacgctttcttgcaaaaatacggtatcaagttgaacgatgcgattctcgctgaggataagcacaaacctatgtatgaagaattggctaacaatcctaatgtggagtacattgctggaggtgctactcagaattcaatcagggttgctcagtggatgcttcaagcaccaggtgccacaagttacataggttgcataggaaaggacaaatttggagaggagatgaagaagaaatgtacacttgatggtgtaaaggttaactattatgaaatcgacaatacacctactggaacttgtgctgtttgtgtggttggcggtgaaaggtcccttgttgccaacttatcagctgcaaattgctataagtctgagcatttgacgagaccggaaaattgggcattagttgaaaaggccaagtatttctacatttctggctttttcctcactgtatctcctgattccatacaattagttgctgaacatgcagctgcaaataacaagttcttcatgatgaacctttctgccccatttatctgtgagttcttcaaggatgcactgaataaagttctgccatatatggactacgtttttggtaatgagactgaagcaagaacattttctaaagctcaaggctgggagactgataatgttgaggaaatagctttgaagatttctcagttgccaaaggcatcggaaacacataaaaggattacggttatcacccaaggtgcagatcctgtttgcgttgccgaggatggaaaagtgaaaatttaccccgtgataccgttacctaaagagaaattagttgacacaaatggagcaggagatgcttttgttggaggatttctttcacaattggttaagcataagcccattgaagaatgcattagagctgggtgttatgcagccaatgttatcatccaaaggcctggctgcacatacccaccgacgcctgattttcattgagtgattcctctttttctgttactgctatgaatttttttctttttatcattgagaaggattttaatagccacactctaactggtgtggggttttttaaccccccggctaggaaaaacagcgtgaaaaagttgcagcaagagataaaacttgaataagttcatatatttgaagtccgatcaagcatcaattctcatattgctgtttgtgatcttttttcattttcattttttccaccttttcttctttttattacagtttatgctgtatttgtacccctatcaaggcacatgtatcttaattatgctgtttgtt

SEQ ID NO: 7928 - DNA, 1587 bp, Glycine max
acactacggactttctcctccaaaaatactactcatgtatttgctgcatctgatcggccaactgtaatttatagtagtaacaaaaaattactttatagtaatgtgaatctgaaggaagtgagtcacatgtgtcctttcaattctgctgcttttccagacagtttggcaattgcaaaagaaggtgagcttactattggcactattgatgatatacaaaaacttcatattcgctctattccgctgggggagcacgcacgacgtatctgccaccaggagcaatctaggacttttgctatttgtagtttgaaatacaacccagctagtggtgaagactcagaaatgcactttgtccgcttgctggatgaccagacttttgagttcatatcaacttattctcttgacacttatgagtatggttgcttcataattagctgctccttctcagatgacaataatgtgtattactgtgttggaactgcatatgtactgccagaggaaaatgaaccaaccaaaggaagaattattgtttttgctgttgaagatggaaaactacagctaattgccgagaaagagacaaaaggagctgtttattgcttgaatgcatttaatggtaaattgcttgcagctattaatcaaaaaattcagctgtataagtgggtgctccgggatgatggtactcatgaattgcagtctgaatgtggacatcacggacacatcctagcactttatgtgcaaactagaggagattttattgtagttggtgatctgatgaagtcaatttccttgttaatctacaagcatgaagaaggtgctattgaggaaagagctcgtgactacaatgcaaattggatgtcagccgttgaaatcgttgatgatgacatatacctaggtgcagaaaacagttttaatctgttcactgttcggaaaaatagtgaaggtgctactgatgaagagcgaggtcgtcttgaagtggttggtgagtatcacctaggagaatttgtcaatcggttccggcatggctcccttgttatgcgcttgccagattctgatgtgggccagattccaactgttatctttggcaccattaatggtgttattggggtaattgcgtctcttccacatgagcaatatgttttcttggagaaacttcagtcaaatttgaggaaggtaattaaaggcgttggagggctcagccatgagcaatggagatcatttaacaatgagaagaaaactgttgaagccagaaactttttagatggagatttgatcgaatcatttctggatcttaaccgcagtaagatggatgaaatttccaaggcagtggacgtttcagtagaggagttatgcaagagagtagaagagttgacaaggttgcactgattttatattaatctgtgtagcttcgttgtttgtttgttttttttttcttatttaatattgttcttccttttttttttgaggggttgggtgggggttaaaataacattatatgcttgtattttctccccgctttttaccttctgtttgcattttacaatacatggatcacaaatggtgtatgaaatggatgtcatgttctaagtttct

SEQ ID NO: 7929 - DNA, 783 bp, Glycine max
aaaaaaaaaaaaatacattcatgttgatagagagcaacataggaagtgaagtgtaggtaagtgagagccatgaagggttatgagccccgttcaagctcttcatgtgcagcttgcaagctattgaagagaagatgcataccaaattgtatttttgcaccttactttaggtctgatgagtgcaagaagtttgcaaaggtgcacaaggtgtttggagccagcaatgtgagcaagattctgattgaagtgccagaagagcagagagaggacacggtgaattctctggcttatgaggctgaggcaaggctgagagacccggtttatggatgcattggtgccatagctctgttgcaaaggaagatggtggagcttcaacatgatctggcaattgcaaaggatcgtcttgcgcgttgtcacgctgctgctgctgctgctactactactatcccttctcctgatatcttgcatgccaatgttagccttcccccattccctgacttttgcacttcttcaagtgatttcaatgatatcttttgccacagttcttcgtctcaattattaggccgacatgaaacggtggatgatttcaatcaaatcccatatatattttgaatgttatgaattatgatgtatgcatgtttatggtccccttttgaatgtaattgttatcaatcaagagcagctacaatatgtcatatgagctaatgaataataagaactccaggagaatcaataggtctgaattgaaaactctctctcaacatgaatgtattattgttttgtgtt

SEQ ID NO: 7930 - DNA, 2667 bp, Glycine max
ccttccctcattcttatttttttcctctcttcactttcactctctctctctctcagccatcatcatgggagcagtgattctcccagatctcggcaccgagattttgattccggtctgcgccatcattggaatagggttcgccctcttccagtgggtcctcgtctccaaggttaagctctccgctgccagagacgcttcccctaacgccgccggcaaaaatggctacaacgattacctcatcgaagaagaggaaggcctcaacgatcacaacgttgtcctcaaatgcgccgaaatccaaaacgccatttccgaaggagcaacctctttccttttcactgaatacaagtatgtgggaatcttcatggtggcttttgccattttgatattcctattccttggctctgtggaaggattcagcacgagctaccagccttgcacctatgatcaaactaaaatgtgtaagccagctcttgctactgctgttttcagcaccatatctttcctgcttggtggtgtcacatcgcttatttctggattccttggaatgaaaattgcaacttacgccaatgcaagaaccaccctggaggcaagaaagggtgttgggaaggctttcattacggcttttagatctggtgcagttatgggttttctccttgctgcaaatggtcttttggttctttacattgccatcaacttgttcaagatttactatggtgatgactggggtggtctttttgaggccatcactggttatggtcttggtgggtcttctatggctttgtttggaagagttggtggaggtatctatactaaggctgctgatgttggtgctgatcttgtcggaaaggttgaaagaaacatccccgaagatgatccaagaaatccagctgtgattgctgataatgttggtgataatgttggggatatcgctggtatgggatctgatctttttggttcatatgccgagtcatcctgtgctgctcttgttgttgcttccatctcttcttttggggtgaatcatgagttgactgctatgttataccctctcattatcagttctgtgggtatccttgtttgtttgctcacaaccttatttgcaactgacttctttgagatcaaggctgtaaaggagattgagcctgcattgaagaaacaactcatcatttccactgccctgatgactattgggattgcaattgttagttggattgcactcccaacttccttcactatcttcaattttggagttcagaaagatgtcaagaattggcagctattcttgtgtgttgctgttggtctttgggcaggtcttattattggatttgtaactgagtactatactagcaatgcatatagtccggtgcaagatgttgcagactcctgcaggactggtgctgcaactaatgttatatttggccttgccttgggatacaagtctgttattattccaatttttgctattgccattagtatttttgttagtttcacctttgctgccatgtatggtattgctgttgctgcgcttggcatgctgagtaccattgccaccggattggccattgatgcatatggtccaatcagtgacaatgctggaggtattgctgaaatggctggtatgagtcacagaattagagagagaactgatgcccttgatgctgccggaaacacgactgccgctattgggaagggatttgccattggttctgctgcccttgtatcactggccctctttggtgcctttgtgagccgagctgctattacaactgttgatgtgttgactccaaaggttttcattggtttgattgtgggtgcaatgcttccttactggttttctgctatgactatgaagagtgtgggaagtgctgctctgaagatggttgaagaagtacgcaggcaattcaacaccattccagggttgatggagggaactgctaagcctgactatgccacatgtgttaagatctccactgatgcttccattaaagaaatgattccacctggtgctcttgtcatgcttacaccgcttgttgttggaatcctttttggtgttgaaacactttctggtgtcctagctggatctttggtgtctggtgtacagattgctatttctgcatccaacaccggtggtgcttgggataatgccaagaagtacattgaggctggtgcttctgagcatgcaagaagccttggtccaaaagggtcagattgtcacaaggcagctgttattggtgacaccattggagaccctctaaaggatacatctggaccttcacttaacatccttattaagctcatggcggttgagtctcttgtgtttgctcccttctttgctacacatggtggcctactcttcaagatctaaaggatttgatagaaaaagagtatcgtccatcatttttctacaacgacagaacaaggaaaagccgtccctttaccaatgccttctcgtttttgtgttagtctttaactcatctgtcatgtcaattccattgtttttgaaaccttttcctcccccaccttgaaacaaagtatattttgtctcatgtagttttaagacaacttgattaggctgagtctgttgcgaaaattttccttgtatgatgacgatgatgtttaccatctcttccgcgtggtcaattttctaaatatattcctttccggatggtt

SEQ ID NO: 7931 - DNA, 2175 bp, Glycine max
ggcacatagcatcggatctgatattggtctgaagatgggtgtggctgctgagtctgagtcaaatgacaacatcccgctgttactcacccaatctgcttaccctctcaaaaggacagggacggtgtggacagcagtggcacacatagtgacaggggtgataggatccggagtgctgtctctgccatggagcactgcacagcttgggtggcttgcaggccccttctccatccttctcattgcttccaccactctcttctcttcttttcttctatgcaacacttatcgccatccccatcccgaatacggtcccaacagaagtgcctcctaccttgatgttgttcatttgcatttaggaataagtaatggacggctcagtggccttcttgtcagtattagtttgtatggttttgcaattgccttcgtcattacaacagctatcagcttaagaacaatccaaaattcattttgttaccacaacaaagggcctgaagcagcatgtgagtctgtagatgcatattatatgctactttttggggctatccaaattgttctctcacagatacccaacttccataacatcaaatggctgtcggttgttgctgcaattatgtcctttacttattctttcataggaatggggctttccattgctcaaatcatagaaaaaggacatgctgagggtagcattggaggaatcagtacctctaatggagctgaaaagttatggctggtttctcaagcacttggtgacatatcattctcatatccattctcgacaattcttatggaaatacaggatactttgaaatcgcctccaccagaaaaccaaaccatgaagaaggcctcagtaatagcggtcagtgtcacaacattcttgtacctcagttgtggaggtgctggatatgctgcctttggtgataatacaccaggaaaccttttaacaggtttcgtatcctccaagtcttattggctagtgaactttgctaacgcttgtatagtggttcacctagttggttcatatcaggtgtatagccagccactttttggcactgtggagaattggttccgttttagattcccagatagtgaatttgtgaatcacacatatatcttgaaactcccgttgcttccagcctttgaacttaattttctcagcctgtctttccgaactgcttatgttgcatccacaactgtgatcgcaatgatatttccctacttcaatcagattttgggggttctgggtagcatcattttttggccgttgaccatatattttccagtggaaatatacttgagtcagtccagtactgtatcatggacgactaagtgggtactgcttcggactttcagcttttttggctttttgtttggattgttcactctcattggatgtattaaaggaatagtaactgaaaaaataagctgagaagctttgagacctctccaaggaattagactcagatagccttcttttttttctccacttttctcctttcaagacccacaaataatgaggatcatctgcaatgtcttttccacatattcactcaattactaacttggaaccattacataaagatcggacatctatctcagtaaattagacataaaacacgtatttgagatccgaactgtccgatctttattcaatggttacaaatgcactaactgtgtgagggcaaggaataggagactgcaccgaatccagttggacaataaacatgcagattctctcatattttcaataggaatagtgattctgtatttgttcacctgctgaaggtatccactgctgaaatgaatgagctcaacactcctacttcctcggttcttccactgttatacaaacaaattgaaagtggacattattattttccgtgggaaaattttcagttctatttgattattgtttgaagtcttatcgatactatttagattaagccaactttggtataaatataagttcctcacaagtgacctctcaatgttgttgaccttttacttcagtaactttgctgcaacccgatcttcgctttggataggattccctattgtaaaaaaatacagtatttaatgtagtaaatctatttacatccatgtctctgcatttccattcagggcataacaaaattggagaatttaaagaaacatgaagcattcgtgttttgattaccc

SEQ ID NO: 7932 - DNA, 1084 bp, Glycine max
ctggtctgcattttgccacaacaaccttgctgacagtctttcttaagtggctgggatatgtccaaacctctcaccttcccttacctgatctcatcaaatttgtcttatttgcaaatttctctattgtcggcatgaacgtgagtttgatgtggaattctgtcggtttctatcagattgctaagctgagtatgattccagtatcttgtttcctggaagttatcttggataatgtgcgatattcaagggacacaaaacttagcatttctctagttctccttggggttgctgtatgtacagtcactgacgtgagtgtcaatgctaagggttttatagctgctgcagtggcagtttggagcacctcactacagcagtattatgtgcattttcttcagaggaagtactctcttggatcgtttaacttgttgggccacactgcaccagtacaggcagcaagtttactactagtaggtccctttttggactattggctgacaaacaaacgagttgacgcctacaactatggtttcacatctactttgttcatcattatctcttgcaccatcgcagtagggacaaacctcagccagttcatctgcattggcaggttcacggctgtatctttccaagtccttggacacatgaagactattctggtactggccttaggattcgttttcttcggaaaagaaggcctcaatttacaagtgattctgggcatgaccattgccatagcgggaatgatatggtatggcaatgcatcttctaagccaggagggaaggaacgtcttagcttacccattaaccataccaccaacaagacacaagagtataatgtactgccagtgtcctctgaaacggatcaggaaatatagaagttgatgtaaataaagtggtgccctctaggacacctcatttggacacttctcctacccgtatggaacacaacatgcttagtcaaatcttcttctctctctctctctgcttacttacagggtttgcaaaacagaaagcttgtgttctccgcaatgaaaaatgacttattgtctcagtttttagaaaaatgaaaattaatttctagtccttc

SEQ ID NO: 7933 - DNA, 1100 bp, Glycine max
ccaaaaccacccaacactcgaactcaatatccattattaccaaaaaaaaagaaaaaaggatatcaaacacccttttcatcattaaaactctcagttccctctttccctatcaaaaccctttcccacaacactactcactccagtacaagaaaccctttttcaatttggtttcaacagcacacacacacacacatatatatatatatagcatgtttaccttgaatcattcttctgatttgtaccatgtttcccctgagctctcatcttccttggacacatcctcgccggcttcggagggctctcgtggcgtggcattttccgacgaggaggtgcggctggcggtgaggcacccgaagaagcgggcaggtcggaagaagttccgggagacgcgccacccggtgtaccggggggtgaggaggaggaactcggataagtgggtgtgtgaggtgagggagcccaacaagaagaccaggatttggctggggactttccccacgccggagatggcggctcgggcgcacgacgtggcggcaatggccctgaggggccggtatgcctgtctaaactttgctgactcggcctggcggttacctgttcccgccacggccgaggcaaaggatatacagaaggcagcagcagaagctgcccaggctttcagaccagatcaaaccttaaaaaatgctaatacaaggcaggagtgtgtggaggcggtggcggtggcggtggcggagacaacaacggcgacggcacaaggggtgttttatatggaggaagaagagcaggtgttggatatgcctgagttgcttaggaatatggtgctcatgtccccaacacattgcttagggtatgagtatgaagatgctgacttggatgcccaagatgctgaggtgtcactatggaatttctcaatttaataatgtgttttggtttggtttttgttgttagttttttggagtgaacagtgtctgtactggttttttattagtagtacggatactagttataggtggaaagattgcgagggaccaaaaggaattttcttttgaacccttttttgtcaatgtaatcaatatcacgtatatcatgaagtgaatcccttc

SEQ ID NO: 7934 - DNA, 1346 bp, Glycine max
aaaggataatagcttttgacctagctaatagcacacaataatgggaagatccccatgctgcgatgagaatggccttaagaaaggtccctggactcccgaagaagatcagaaactagtccaacacattcagaaacatggccatggaagttggagagccctccctaagttagctggtctcaatagatgtggaaaaagttgtaggctaaggtggactaactatttaaggcctgatatcaagagggggaagttttctcaagaagaggagcaaacaattctgcatctccattccatccttggaaacaaatggtcagcaatagcaacccaccttccaggcaggacagacaatgagataaagaatttctggaacactcacttaaagaaaaagctgattcagatgggctttgatccaatgactcaccagcctagaactgaccttgtttccaccttgccttatctgctagctttggccaacatgacagacctcatggaccatcagacattggatgaacatgctataaggttgcaagcagaggcagtccatctggcaaagcttcaataccttcattatctaatccgatcctcaaactccttgagcaccaacaagtcctatgaccaaagtgccaccaccaacatggaacctgcagctttcagtttgttgaactcaatctccaatgtgaaagagaatccagtcatgttgcaaccagctgatgatactcctgctgcctcattgtctcatggcattgttagctctcaaccactccaccccccaaacgtgctacctcatcaccttttagagccacaagtctctttcagctctcaatcatgtttgaatagtgagattggtcaaggtactaactttgcaatcataagtcaaggggatcacacgcttgatcttgactcttcctggattattccatctattactcctccaaatgcaatagggacctcagctaacaatccaggagatgccagcagcagcacttctagctatggaggaggaccctcttcttattggtccgaactactttttgaggaccccatcttgcatgagctatcttagtatttaatttgaaagaggtcccattatggtgtgtgcatgttatgccttgtttgcttcttgccacttaattaattagcccatatatatgctctagtataggtacatatagatatatatatgcccttttacatatatacgtattcacgtatcaatacatgttttgtacataactccgggacagtttcatcgagctagtttgaatgtcactatgacagtatcgttttcagcagttatatatctaaattttctttgctcaaataaaatttgtttttacgttttttatttt

SEQ ID NO: 7935 - DNA, 1312 bp, Glycine max
ggataatagcttttgacctagctaatagcacacaataatgggaagatccccatgctgcgatgagaatggccttaagaaaggtccctggactcccgaagaagatcagaaactagtccaacacattcagaaacatggccatggaagttggagagccctccctaagttagctggtctcaatagatgtggaaaaagttgtaggctaaggtggactaactatttaaggcctgatatcaagagggggaagttttctcaagaagaggagcaaacaattctgcatctccattccatccttggaaacaaatggtcagcaatagcaacccaccttccaggcaggacagacaatgagataaagaatttctggaacactcacttaaagaaaaagctgattcagatgggctttgatccaatgactcaccagcctagaactgaccttgtttccaccttgccttatctgctagctttggccaacatgacagacctcatggaccatcagacattggatgaacatgctataaggttgcaagcagaggcagtccatctggcaaagcttcaataccttcattatctaatccgatcctcaaactccttgagcaccaacaagtcctatgaccaaagtgccaccaccaacatggaacctgcagctttcagtttgttgaactcaatctccaatgtgaaagagaatccagtcatgttgcaaccagctgatgatactcctgctgcctcattgtctcatggcattgttagctctcaaccactccaccacccaaacgtgctacctcatcaccttttagagccacaagtctctttcagctctcaatcatgtttgaatagtgagattggtcaaggtactaactttgcaatcataagtcaaggggatcacacgcttgatcttgactcttcctggattattccatctattactcctccaaatgcaatagggacctcagctaacaatccaggagatgccagcagcagcacttctagctatggaggaggaccctcttcttattggtccgaactactttttgaggaccccatcttgcatgagctatcttagtatttaatttgaaagaggtcccattatggtgtgtgcatgttatgccttgtttgcttcttgccacttaattaattagcccatatatatgctctagtataggtacatatagatatatatatgcccttttacatatatacgtattcacgtatcaatacatgttttgtacataactccgggacagtttcatcgagctagtttgaatgtcactatgacagtatcgttttcagcagttatatatctaaattttctttgctc

SEQ ID NO: 7936 - DNA, 1057 bp, Glycine max
gcaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaatattaagatattgttctctagc

SEQ ID NO: 7937 - DNA, 1807 bp, Glycine max
ttgtgatctctccgtagggacaataccatgcctcttggtcctttctctaatccaaatatctctccgttaatgctctcaccacaaacttcaatagactagccaaaagctaacaccaactataggccaaatcaccaataaatattatttcccgttcttttggcgtgttggccacccactgaacacatttgcactcacacatagaagcagagagaggccattggttggtttcagagatgggaagcatgcacatagaaaccccagaaacttttgctgatggtagcaaaaacttcgatgatgatggacgagctaaaagaactgggacttggattactgcaagtgctcatatcataacggctgtgattggttctggagtgctatctcttgcatgggcaattgcacagatgggttgggtagctggtcctgcagtgctctttgtcttctctttgataacatacttcacctccactcttctcgctgactgttaccgttcacctgaccctgtacatggcaagcgaaactacacatattctgaggttgtcaaagccaacctaggaggaagaaaatttcagctgtgtggattggctcagtatataaatcttgttggtgtaacaatcggctacactataactgcatcacttagtatgggggcggtgaagaagtcgaactgtttacacaaacatggccatcaagacgagtgcaaagttaaggacaacgcttttatgattgcttttgcctgcatccaaattcttctaagccaaataccaaacttccataagctctcttggctctctatcgtagcagctgttatgtcttttgcttattcttccattgggcttggcctttccatagccaaaatcataggtgggggacacgtgcgaacaaccttaacaggggtggaagtttcgggaacggaaaaggtttggaaaatgtttcaagctatcggtgacattgcctttgcttatgctttttctaatgtcctaattgagatccaggacacactgaaatcaagcccacctgagaacaaagtcatgaagagagcaagtttgattggcattatgactacaacattgttttatgtactatgtgggtgcttaggctatgctgcatttggaaatgatgcaccatctaatttcctcacaggattcggcttctatgagcccttttggctaatagactttgccaatgtctgcatagcagtgcacttagttggggcataccaggtctttgtccaacctatatttgggtttgtggaaaagtggagcaaagaaaattggacagaaagccaatttataaatggcgagcatactttgaacattcctctatgtggaagctacaatgtgaacttctttagggtagtgtggaggactgcatatgtgattatcactgccgttgtagctatgttactcccattcttcaatgactttttggcccttattggtgcactctctttctggccattgacggtttacttccctatagagatgtacattaagaagtcaaatatgcaaagattttccttcacctggacttggctcaagatattgagttgggtttgcttgatcatttctattatctcacttgtgggttccatccaaggcctttcggttagtatcaagaaatacaagcccttccaagcagaacaatagaactttcatacttagtattccaacttgagccaagagtttctattgagggcgacaaaatttgtattactatgttttgaaatagttgttatattttcaattctcgaaatcgagacaacttgttatactaaagtaatataataaaatgtttagtttgctatgtt

SEQ ID NO: 7938 - DNA, 1974 bp, Glycine max
caacacaagagtcgcatctcaagcttttgtctttctctacttttcttcttctttctgtgtatcgtatcgtattggtaggttgaaaaacaaagagtgtgtgttgttgttgtgtggtttggttttcacttttgttcatcgtttgcgagacacacaggagagaagagatggcgacgagggtggtggcggaacagaagccgaagacgaagattgtgtgcacgctggggcccgcatcgcgctctgtcccaatgatcgagaagcttctgcgggcgggcatgaacgtggctcgcttcaacttctcccatgggtcccacgagtaccaccaggaaaccctcgacaacctccgcgccgccatggagaacaccggtattctctgcgccgtcatgctcgacaccaaggggcctgagattcgaactgggtttctcaaggacagtaagcctatccaactgaaacaaggtaatgaaataaccatttccactgactatgacctaaagggtgatgagaagacgatttgtatgagctacaaaaagctgcctgaggatgtgaggcctgggatggtcatactctgcgcggatggcaccatatcatttacagttttatcatgtgacaaacaagcgggtttggttcaatgccgatgcgagaactctgccactcttggtgagaggaagaatgttaatttgcctggagtgatagtggatctcccaactttgacagacaaagacaaggaagatatcttggcctggggagttcccaataaaattgacatgattgctctttcttttgttcgaaaaggttctgacctggtggaagtcaggaaagttctgggaaaacatgccaagaacattatgctcatgtctaaggttgaaaaccaagaaggggttgcaaattttgatgaaatccttgcaaattcagatgcatttatggtggcacgtggtgaccttggaatggaaattccaatagagaagatatttcttgcacagaaagtgatgatttacaagtgcaacatccaaggaaaaccagttgtcactgcaacccagatgttggagtcaatgatcaaatctcccaggccaaccagggctgaagctactgatgttgccaatgcagttctggatggcacagactgtgtgatgcttagtggtgaaaccgctgctggagcctatccagaccttgctgttcgaacaatggctaaaatatgcattgaagcagagagcacccttgactatggagatgtgttcaaaaggattatggagcactcaccagtacccatgagcccattggagagtctagcttcttctgctgttagaacagccaactcggctagagcagctcttatcttggttttaactagaggagggagtactgcaaaattggtggctaaatacaggccaggcatgccaattctttctgtggttgttcccgagcttaagaccgatacctttgactgggcatgcagtgatgaggcccctgcaagacatagccttatattccgcgggttggttcccgtattgagtgcagcttctgctagagcttctcatgctgaaacaactgaagaagcaatagaattcgccatgcaacatgccaagtccaagggtctctgccacaacggggattcggttgtggcacttcatcgtgtgggcactgcttctgtcatcaagatcttgactgtgaaatgatcaccccattacagggaattcttctgctgtttttggcaaattttttagatggtgcaaaagaggtctcgttatacctcttcatatctacattggatgcaaacttcaatcaaaagcatttatcaggatgggttacctgtttttcacatatcttatattactgtttttttttttttttgttacatttgccttatcattgtggcgagcagccacctgctttcatttgttaagattttgtatgaggcttttggtgaaccaaaaaactagccacttctggattttgaattctacggtctaaagttgtttt

SEQ ID NO: 7939 - DNA, 1486 bp, Glycine max
ctcggtttccactttctctctgtttaagaactcaccacttcttcaacttggtgccgttgtttcatggaccagaactacgcctcatagctcctttctcatttcacacacacaaagaaccttgagacatcatgaagattccaagttccaagcaactggttgtgggatttgcacttggaaatgaaggataggcaacgttggagagctgaagaggatgctttactacgcgcatatgtcaaacagtatggtcctagggaatggaatctggtgtctcagcgcatgaacacacctcttaacagggatgccaagtcatgcttagaaaggtggaagaactacctcaagcccggcattaagaaaggatctcttacagaggaagagcagcgtctagtcatcaaccttcaagcaacacacggcaacaagtggaagaaaattgcagcacaagtccctggtcgcacagcaaagaggttagggaagtggtgggaagtgttcaaagagaagcagcaaagggaaacaaaggggaataactgcaccattgacccaattaacgatagcaagtacgagcatatccttgagagttttgcagagaagctagtgaaagaaaggccttcaacatcaacatcaacatcatttgttatggctacttccaacagttcttttctgcatgctgatgcaccggctcctgcaccagccttgcttccgtcttggctttccaattccaatggcactgcacctgtgaggccaccctccccttctgtgactcttagtctttctccctcgacggtggcagcgcctcctccatggatgcagccccccgtcagaggacaggacaatgctagtcctcttgttttggggaatgtggcgcctcacggggctgttctagcatttggtgagaacatggtgatgtctgagctagtggagtgctgcaaggagttggatgaagtgcatcatgctttggccgggcataagaaggaggcagcatggcggttaagcagggtggagctgcagttggagtctgagaaggccgggcgaaggagggagaagatggaggaaatcgaagcgaaaatcaaagctctgagggaggagcaaacggctgcattggatagaattgaagcagaatatagggagcagttggcagggctgagaagagatgctgaaagcaaggagcaaaagttggctgaacaatgggctgcaaaacacttgcgacttactaagtttctagaacaggtagggtgcagatcaaggctcactgaaccaaatggaagatagagtgacatcaatcattcacaaattgggaaaatctagtttgcttttacttattattatgtcttgaatttatatgatatgaactttatagtcatagtagttttgttcctgtcatttttctaaaatatgttgttacatatggttattgatatcatccctatcttttcatacaacttgaggacttgcattagcggttgagttatgtttaaatataacatcctttatg

SEQ ID NO: 7940 - DNA, 1052 bp, Glycine max
aagtgttgtttagttaattttgtctgatttttgacctggttagacaaagtctgttttatgctcagaatctacattaaatggttgagtgtatgaagaaagtagcaaaacttgatcttgatctaactgtggaagaaaggaacctcctctcagtgggatacaaaaatgtgattggtgcacgaagggcctcttggcgcatcatgtcctcaattgagcagaaggaagagtctaagggaaatgagcacaatgttaaactgatcaagagttactgccaaaaagttgaggaggaactctccaaaatttgtggggacattctgactattatagaccagcatttgattccttcttccgcatcagcagaagctagtgttttctactataagatgaaaggtgattattttcggtatcttgctgagttcaagactgaccaagaaaggaaagaggcagctgaacagtcactgaaaggatacgaggctgcttcagccactgcaaacacagatcttccatcaacacatccaatccgtcttggacttgcactcaatttctctgtcttttattatgagataatgaactctcctgaaagggcctgccatttggctaagcaagcttttgatgaggcaattgcggagttggacaccctgagtgaagagtcatacaaggacagcactttgatcatgcagctgttgagagacaacctgactctctggacctctgatttgcctgaggatggaggtgaggacagcataaaagctgaagaaaccaaaccttctgagcctgagcattgatgtgattcaatagtcagaaatctaaggtactctcaaagaggacattttctagcaatggatttggacccggacaatagggactgtggttggtggccatttcataattcttatgctctcttaatatctttaccaaagctagaagatctgcaccctttttttttccttcaaacttttttcttattaccttctctctgttttaagtaaaatggtcagttaagcaatgaacaatttacatttacccttataagcatcttcattccttcgttcaaa

SEQ ID NO: 7941 - DNA, 1073 bp, Glycine max
cctctctctctttctctttctctctcatccagatcttgcaaaaaaaaaaaaacacaatggcagcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgcaacctcctctccgtcgcctacaagaacgtaatcggcgctcgccgcgcctcctggcgcatcatctcctccattgagcagaaggaggagagccgcggcaacgaggaccacgtcgccgtcatccgtgactaccgctccaagatcgaggccgagctctccaacatctgcgacggaatcctcaagctcctcgacacgcgcctcgtcccctccgccgcctccggcgactccaaggtcttctacctcaagatgaagggagactaccacaggtacctcgctgagttcaagaccggcgccgaccgcaaggaagccgccgagagcacgctctccgcctacaaagccgctcaggacattgctaacaccgagctgcctccaactcaccctatcaggctgggtcttgctctgaatttctctgtgttttactatgagattcttaactctcctgatcgtgcatgcagccttgcaaaacaggcttttgatgaggctattgctgaattggatacgttgggagaggaatcatacaaggatagcactttgatcatgcaacttcttcgtgataaccttaccctctggacctctgacatgcaggatgatggtgcagatgaaattaaagaagccgcacccaaaggtgacggggaacaaaattaaacataccatacttctaattagtgattgaacttcccttgtgtaatgttttcaaagggagaaggtgttgaatgctaatctcggtgttactgagattttgggcattcatgttcttcgttatgaattgtggatgtactgggctattttagtttgtccttccattagtacgcgtttctgaactgcctattttcataatgacactgaaatttccattataatgctgtttagaat

SEQ ID NO: 7942 - DNA, 2308 bp, Glycine max
gcccccaaaacagagcaaaacagaggatccactccaccactactcctaatggatcctccacccctctctgccgccactcaaaaaaaccatcccgaatcggtagagtccttttctccatgtttccgcgttgcggaaacgtggactgatgagactctaccggcggttcctggtgccaagctgcgcctcatgtgcagctacggtggccacattatgccacgccctcacgacaaatctctcagctacatcggtggcgacacgaggatcgtggtggtggaccgccactcgtcgttgaaagatctatgttcacggctttcccgaactatcctcaatggaagacccttcacactcaagtaccagcttcccaatgaagaccttgagagtcttatcactgtcaccactgatgaagaccttgacaacatggtggaagagtatgatcggataatggcaaaaggttcggcttcttcgcggctcagggtgttcctgttcttcaccaaacctgaggccacagtttcaatggggtcactccttgatgatgccaagtcggagacatggtttgttgatgcactcaacaactctggcatgatatcaagagtggtgtcagattctgctgccggggattcttttgttaaccttgatggtgttggtgttggtggtgttagtgctagtggttcaagcaacaacttggagtctttgcctgatgctaacaaggttaagaattttcctgaagtggtgcaagtgcaatcaacacctggttcgcctatgatggagaacagttcttcttctccttctttctctccttctctggttaatctgcctccaattcgggttcatgttgatgacaatggtagtaggcttcagcaagagaataaggttggtttggtggtggaggagcaatttgctcagatgacaattgcaagtggggtgaagccagatgatggattggtgaatgttgtttcttctgcagtggctgtgcctgtaattcctgcatctgtgactatggcatcagctggggtgattactactagtgataatgtgatgaatagagttgtttgtgaggatgacagatcagatcccgggtttcagaagccccctttaccattgcagcttgtgcagccaaggactagtggtggtgtgggtttgccttcacctgattcagttgcaagtgatagtagtattgcagctgcaaattctttctccaagactgtttactaccaagatcaagtccaagctgcactactagacaacaaaattgttgctatgccaaatgccaagagtgaaatatctgatcagatgattcaggtccaaggacaacttcaagattctggctacacattacccccacaattggatccaaacaagcaacatttccagcagcagaagccatttgtccatgccagcactcactacatccaccacccagcagccacaggtccagtgccagtttcatcatactacccagtttatgccccaccacaacctcaacaacttcaccctccaattggtcaacaacagtacccagtttatgtaatgccagttggacctacacaagtaacacaaccctacaacatggcattgcagcccaatatagctgatcctaatgtggtagcttcaagcaggtcattaatgccacaaagtattgttacctcagcagcatacaaagatggtactccacctatttaccccaccaagtcagttagctctactatggcatcaaattctggatatgctccaatacctaccaaccaatttcaaccacagtatgtgggtttgcatcagttccatcatccaccacagtccattgctgtggctccttctagtactactactaataataattatggttatgaatatggtggccatgtgcaagaccaagcttactacactcaacaaaccaccactgctccattgcttcctcagtaccaatccatgaccccagctgcagctgctgcagcactatcagatgcttcaaaatagtttcctgcagacaacattcagcagccaactagagcatcacaaccagtatgaatcaaaaagtggagaaaaatgaatgaatgagtttggtggaggcatgttggggaggggtggggtgaggggcaattagactttactttcattttttaaccatgaacatatgcaccctaatttctacagaaaaaaaaaaaaaaggaaataaggagtaaagcataggttatttcttttttatctataatgaaatgaatgacatgtaagatcatattctgcaaacttagctttttctggtcgtcacagtttactcagttgaataaagcaagttgttgccattaaaaaa

SEQ ID NO: 7943 - DNA, 1250 bp, Glycine max; identical to SEQ ID NO: 447

SEQ ID NO: 7944 - DNA, 2101 bp, Glycine max
acagagcgcagaaaataaaataggtgaaatgaatatcgatttcaattccgccactgaatttcgaaaccaaaaaaccattccaacgaagaagatgaacctcgaagaagagggttagttacttctgagtgagtgagtgagttagtggttcctctgaggaacggtgaggaccttcaatttctcaagttctcaaccgttcgttttctctttcgttcccctaaccgccgtggatgggacaatctgtttcctccgccgccgtcgctagccgtcgcgagagggaccaaggccaccgctccgtcaactcttccaagaccagattcaccgcctcggtttcgccgatggccggttattcctccggcgccgccgaagaaggcgaaaaccatcgcgtggaggccgttgccgatgaatccaccgactacatctccgatctcccgaacgagtgcctggcttcggtgtttcagtttctcagctccgccgatcggagccgctgttcgctcgtttgccggcggtggctccagatcgaaggacagagccgccacaggctttctctgaacgccgaactggatctgtttccggcgattccgtcgctgttctctcggttcgattcggtgacgaagctcgcgctgaagtgcgaccgcagatccgtgagcatacgcgacgacgcgctcgtgctgatctcgcagcggtgccctaacctcacgcgcctgaagcttcgcgcgtgtcgcgagctcaccgacgcaggaatggaagcgttcgcgaagaactgcaagggattgaagaagctctcgtgtggatcgtgcacgtttggatccaaaggcatgaacgcggtgctcgacaactgcgccgcgctggaggagctctccgtgaagcgcctccgtggaatcgctgacactgcagcggcggagccgatcggtcccggcgtggctgcggcgtcgctcaaaactgtttgcctgaaggagctatacaacggacagtgtttcggaacgctgattctcggcgcgaagaatctgaaaaccttgaagcttttccggtgctccggcgattgggaccggctctttcaattattggtggatcgagtcacgaaaattgttgaggttcacctcgaaaggcttcagattagcgacgttggattgcaagcgatagcgaattattcgagtttggagattttgcatcttgttaagacacctgaatgttctgatattggacttgttgctattgcagacaggtgcaagcttttgaggaagcttcatattgatggatggaaggcgaatcgaattggggacgaaggtttgatagctgttgcaaaaggttgccctaatttgcttgaattagtgctaattggggttaaccctactaaggcgagtttggaaatgttggcgtctaattgccagaatctcgagcggttggctttgtgtggaagtgattcggttggtgatcctgagatatcttgcattgctgcaaagtgtgtggctttgaagaaactgtgtattaagagttgtcccgtttccgatcaagggatggaggcattggggaatgggtgtccgaatttggtgaaagtgaaggttaagaagtgtaaaggggttacccctgagggtggtgattggttgaggaggactagagggtcagttgctgttaatttagatactggtgaggcagagcttcaggaagccagtgctagtgatggaggggcacaggacaatggtgtagagttccctcaaatgcctgcccaaatcgctgctgcatcgagcagcactcggtctagttcgtcgaggtttgcgcttatgtctgcgaggatttcagcggctgcattgaggagcactcggtctggttcgtcgaggttagggcttttgcctacgaggatttcagcggctagcacttttaggagatggtctggtggtagcactagtgcacgccatggttagggacagggccaaagcaaaacctgagtctttgaccatttttcattgtttttggttgtcgtatcatttgatttttatatttcttgtacttaaatttgaaatttatgccgtgtgatgtttattgcctttggaattgaagcttcacggttgcaattgacaatcgcatttttttcctttctaaaaaa

SEQ ID NO: 7945 - DNA, 1142 bp, Glycine max
gaagaattaaaggaagcctaactggtgtaactattgggactgtgacagaatcccaaaaaatttggagaactttccaagcgcttggaaacatagcctttgcttactcctactcaatgatccttattgaaattcagaaaacaacacaaacaacaaattgaagtctaaattaaaatggtggttgttatggaacaggacacaatcaaatcccctccagcagagtcagagacaatgtccaaggctactttaataagtgttttggtcacaaccgttttctatatgctatgtggttgctttggctatgcttcttttggagatgcaagtccgggaaaccttctcactggctttggcttctataacccattttggctcattgacatagccaatgctggcattgttatccaccttgttggtgcataccaagtttactgccaacccctcttctcattcgtcgaatcaaatgcggcagaaaggttccctaatagtgattttatgagcagagagtttgaagtaccaatccctggttgcaaaccctacaagctcaacctcttcaggttggtttggaggacactttttgtgattttgtcaactgtgatagccatgctcctaccattcttcaatgacattgtagggcttattggagccattggattttggcccctcactgtgtatttaccagtggagatgtatataactcaaactaagataccaaagtggggcataaaatggataggcctacaaatgcttagtgttgcatgctttgtaattactatattagctgcagcaggttccattgctggggttattgatgatcttaaagtttacaagccatttgttaccagctactaattcaataggataattacttagtgatcatgatcaccattgtcagagatttcattagcaacaagaaaaaaaaaagaaggtaaattgttgcaaattgaaatcaacaggaaggtggtcttacttgtttattgcttagtaaccttgtatcttctgtatctttgtttttttttgtttgtgtgtgtgtgttctcttactttgtaacttgctctgtatccctaatttgcaatgagaaatggaggaaatgaagcagaggctttcaaattatcaaagcttttctctctgagtcaagccacttgcat

SEQ ID NO: 7946 - DNA, 1053 bp, Glycine max
gggggttataactcctttgtcagaacagctaacaaagccattacccaatgccatggttctagtaaaccttaaggaaatatcttccagagcttataagcttttgccacaaggcacacgcttggttgtgtctgtacgaggtgatgagccttatgaagaactggacattcttaaaggcattgatgctactatgcttctccatgaccttccttatacagaagacaaaattagcagagtgcatgcggccaggcggttatttgagtacctatccgacaattctctaaacttccctgttattcaccatattcagttcccaaatgggattcacagagatgacttggtaattggtgctggttctgatgctggagcccttctggtggatgggcttggagatggacttcttttggaagcgccagacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccccggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagaacatggacgatgggtggaccctcctgccgaggagtaaaagcaagagcttaattttgagattggcattcaaggccatagtaagatgagcattgtcatatccaattattgtacacatgtaatataagataacactcaatgcttaagtttgagcctagttttaagttccttttgagaaagatcccaattaaagcttgttgtgaggaaatcgacagctagaacatgtatacagataacagtgtattgctttgccccatcagccatcaataataatgagaatctcttagaatagtgccagtt

SEQ ID NO: 7947 - DNA, 2400 bp, Glycine max
gtgccggctgtgatgcaggcgacgcagggggaacagagcaacaatgcctccgctgttcattgggagcgctttctgcctcggatggtgcttcgggtcttgcttgtcgaagctgatgattctactcgacagatcattgctgcacttctccgtaaatgcggttacaaagttgttgcattttgtgatggcttaaaggcatgggagacattgaagaacaaagcatttgacttagatctcatattaacagaagtggatttgccatcaatatctggattttcacttcttactttaatcatggagcatgacatttgcaaaaacattcctgtcataatgatgtcttctcatgattcagtaagcatggtgtttaaatgcatgttaaaaggtgcagctgattttcttataaaacctgttcgcaagaatgagctaagaaacttgtggcagcatgtatggagaaggcacgccataagcaggcctcctcaaaatttaacactgccggagattgaacttggttttgctgcagaaaaccatgctgcaagcaatgactctagtggttctgtggcttctacaccaaaagatgatgaatgcagtgagaaaacaagtgaggctcatagcacttgcccatcgccatttttggaagctgagagtacctacatggaaaatatgcaggatatattgcagctgaagagctcttcaaatttgagcaatattgacacagtgaagcatgaaaactctaccaaatgtgaaagggagtcagataagcataatgatgaagctggagagaaatcactgtttatattggaagatgcaaggtgcaacaaaacttttaaaccaacaggtttaaggctaggtcaaagctatgagtgccatgaaacgagaaatcaagatgaagttctaagaatagagttgataaaatccaatcctgaaattaatacagatattcatagatgcagtgatgaactggtagatccttctactggcgccattgacttgattgctacattcaagaatcttccaaagagcactgatgaaaaatgtagtttcagtagtggtaacactgccaagtttgattttgatacacaattggaactttctttaagaagagattttcctggaagctcatgtaaagctgcattcaaggaaaggcaaatattgaaccattcaaatgcttctgccttttctaggtatagtaatagtaagttgttgcagcccctttttccaacaccatcaactatctctgctaaattaaccaatgccagtcagaattctcatgaatcccttaaattatcaaaaaatacatctacttctcatcaatatagtgaaaaaagtcaaaatcaggaggagaaaatcatcacttcagtcattggtcagtctggacaagttgatccaaaattaccaaacagtcaacttggattgtttcctgctacaggggttacttctgatcacaagtctaaaggaaatggaaatgtcttcccttctaagctttatgcaaaatcaggtgtccatcccatatcgactccaaaatcagtgtgccagaaagagagttctccatttcccacaagcacttcctcccagtccaatcctcaaagtcacaactcagaacgtcatcactggttggaagatgcaacccatgcttctgatcaaaatgtaaatgatcaaagcaatttggaatgtgagacacatgactctcctgctgctagtcagagtgctggtcctagttttttccatgacacagcaaatcataatagtagtggtgtatacagaagtgatggaaatgctacttcagctaaggtagccaaggagagccatgaaatttttattgatagtggtcaacgcagttatgatggattcatagggacagattctcatcgcactagccaacgagaagcagctctaacaaagtttcgactgaagcggaaagacagatgctatgagaaaaaggtgcgatatcaaagccggaagagattggcagagcagcgccctcgcgtgaaagggcaatttgttcgccaagtacacgatgatcatccagtagcagatgtgggtggtggttcctgaaattgttttgttaccatcatcattgaattacagtctgacttccaaaactgatttgcctctcttgacaaggattaactgtaggatctagtttgtctggtgaaattatgtttcttcttagcattgttagtattttcttctggtttgttatattggctgtctcttagaatgtaggattgtaattatttagtaggattgatttgaagttttgattttacctagagtatttgttttcttgattgaatactaatatagggctatcgttgtataggcagtatgcgtctgtcttgaaagattcaaataccttttatatatatatatatatatctcggcaagcatctctggtttgcaatc

SEQ ID NO: 7948 - DNA, 691 bp, Glycine max
acacattaacctttctcattccccatctcctcaccttattcagccactgctaatttctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgcacatggtggtgtgcttccaaacattaaccctgttttgttgcctaaaaagacggagagggctgccaaggagcctaagtctccatccaaggctactaaatctcctaagaaggcctagattatccttttttttttttttttttaaatctagtgttgtatatcggtgcttagatgcttttggtgtaacaggaaatttgatgtgtttcttaaacattgtaattcttgtcccattgtgttgcttgtaggagtgagtttgctttattaatgaaaagtggaaacctcttgttttc

SEQ ID NO: 7949 - DNA, 1668 bp, Glycine max
gaaaccctaaaccccgttttcggtgagatcgagatcgatcgaacatggatgaggagtacgatgtgatcgtgttgggcacgggtctcaaggagtgcattctcagcggtcttctctccgtcgatggcctcaaggttctgcatatggataggaacgactattacggaggagaatccacttcgctcaatcttattcagtttgaactgcgaaatgatgattttctctgtcctcctcttcagctttggaagagattcaggggagatgacaagcctcctccacatttgggcgctagcagggactacaacatcgatatgaaccccaagtttattatggctaatggcaatttggtgcgggttctcatacataccgatgttactaagtatctctatttcaaagctgtggatgggagctatgtgtttaataaaggaaaggttcataaggtgcctgcaaacgacatggaggccttgaagtccccacttatggggctatttgaaaaacgccgggcacgcaagtttttcatttatgtgcaaaactacaacgagagcgatcccaagacccacgaggggatggacttgacaagagtgtctactaaagagttgatagcaaaatacggccttgatgataacactatagacttcattggtcatgctttggcgcttcatagcgatgatcgctacttggctgagccagcactggacaccgtgaagagaatgaagttatatgcagagtctcttgcacgctttcaaggagggtcaccttacatatatcctttgtatggtttaggagagcttccccaggcatttgcacggcttagtgctgtttatggtggaacatatatgttgaataagcctgagtgcaaggtagaatttgatgaggaaggaaaggttgttggtgttacatctgaaggggaaactgcaaagtgtaaaaaagttgtttgtgatccatcatatttgcctggcaaggtgaggaaggttgctagggttgcaagggcgatagccatcatgagccacccaatccccagcactgatgattcccattcggtgcaaattattttaccacagaaacagttgggtcggaagtcagacatgtacctattttgttgttcgtatactcacaatgttgctccaaagggaaaatttattgcatttgtatcaaccgaggcagagacagatcagccggcaattgaactgaaacctggaattgaccttctaggacctgttgatgagatattttttgatatctatgacagatatgaaccagtcaacgaacccactttggacaactgctttatatcaacaagttatgatgctactactcactttgagtcgactgtggatgacgttctcaacatgtatacattgataactggaaaggttattgacctcagtgtggatcttagtgctgctagtgctgcagaagagtaaagaaaactcggtgatgatctgttgctgatgggttccgtgatgatggacttgacaacgaatgttattaacgttttataataaatattttctttttttaaaacaagatttgtgtggctggggaactttttcccgtccagaagctctgttgtgtgttcacatacattgccttctgcagtggttttagtttggtaatgtagtgttattttcatattgttaaatgttaattgcacgtctctccaaccatttc

SEQ ID NO: 7950 - DNA, 2173 bp, Glycine max; identical to SEQ ID NO: 457

SEQ ID NO: 7951 - DNA, 2493 bp, Glycine max
tttcactttaccaactcctaacaatttctctctgtttccttcttcaccgcatcaatggagttggacggcgttctcctcggcatgtgcaaccctctcctcgacatctctgccgtcgtcgacgacgctttcttgcaaaaatacggtatcaagttgaacgatgcgattctcgctgaggataagcacaaacctatgtatgaagaattggctaacaatcctaatgtggagtacattgctggaggtgctactcagaattcaatcagggttgctcagtggatgcttcaagcaccaggtgccacaagttacataggttgcataggaaaggacaaatttggagaggagatgaagaagaaatgtacacttgatggtgtaaaggttaactattatgaaatcgacaatacacctactggaacttgtgctgtttgtgtggttggcggtgaaaggtcccttgttgccaacttatcagctgcaaattgctataagtctgagcatttgacgagaccggaaaattgggcattagttgaaaaggccaagtatttctacatttctggctttttcctcactgtatctcctgattccatacaattagttgctgaacatgcagctgcaaataacaagttcttcatgatgaacctttctgccccatttatctgtgagttcttcaaggatgcactgaataaagttctgccatatatggactacgtttttggtaatgagactgaagcaagaacattttctaaagctcaaggctgggagactgataatgttgaggaaatagctttgaagatttctcagttgccaaaggcatcggaaacacataaaaggattacggttatcacccaaggtgcagatcctgtttgcgttgccgaggatggaaaagtgaaaatttaccccgtgataccgttacctaaagagaaattagttgacacaaatggagcaggagatgcttttgttggaggatttctttcacaattggttaagcataagcccattgaagaatgcattagagctgggtgttatgcagccaatgttatcatccaaaggcctggctgcacatacccaccgacgcctgattttcattgagtgattcctctttttctgttactgctatgaatttttttctttttatcattgagaaggattttaatagccacactctaactggtgtggggttttttaaccccccggctagggaaaacagcgtgaaaaagttgcagcaagagataaaacttgaataagttcatatatttgaagtccgatcaagcatcaattctcatattgctgtttgtgatcttttttcattttcattttttccaccttttcttctttttattacagtttatgctgtatttgtacccctatcaaggcacatgtatcttaattatgctgtttgttatcccaaccttcaagcaacacacggcaacaagtggaagaaaattgcagcacaagtccctggtcgcacagcaaagaggttagggaagtggtgggaagtgttcaaagagaagcagcaaagggaaacaaaggggaataactgcaccattgacccaattaacgatagcaagtacgagcatatccttgagagttttgcagagaagctagtgaaagaaaggccttcaacatcaacatcaacatcatttgttatggctacttccaacagttcttttctgcatgctgatgcaccggctcctgcaccagccttgcttccgtcttggctttccaattccaatggcactgcacctgtgaggccaccctccccttctgtgactcttagtctttctccctcgacggtggcagcgcctcctccatggatgcagccccccgtcagaggacaggacaatgctagtcctcttgttttggggaatgtggcgcctcacggggccgttctagcatttggtgagaacatggtgatgtctgagctagtggagtgctgcaaggagttggatgaagtgcatcatgctttggccgggcataagaaggaggcagcatggcggttaagcagggtggagctgcagttggagtctgagaaggctgggcgaaggagggagaagatggaggaaatcgaagcgaaaatcaaagctctgagggaggagcaaacggctgcattggatagaattgaagcagaatatagggagcagttggcagggctgagaagagatgctgaaagcaaggagcaaaagttggctgaacaatgggctgcaaaacacttgcgacttactaagtttctagaacaggtagggtgcagatcaaggctcactgaaccaaatggaagatagagtgacatcaatcattcacaaattgggaaaatctagtttgcttttacttattattatgtcttgaatttatatgatatgaactttatagtcatagtagttttgttcctgtcatttttctaaaatatgttgttacatatggttattgatatcatccctatcttttcatacaacttgaggacttgcattagcggttgagttatgtttaaatataacatcctttatg

SEQ ID NO: 7952 - DNA, 1463 bp, Glycine max
tacggaagacgacagaaggggggtgtaagtgttgttcttccgatttggttcaatcaaatcaatgatgttgaggaggaggggttctgtgacctccttctattccaaattcatcgattctcacaatcttaattgtgggcgttcctcttcgaatccccatcgcgtcgccgcttctgcaacttcattcgatatctcttccgcttctgcgtctaaagctacgaccgactttgtgtcgttgacccgccactatggaaggtgctattgggagctctccaaagctcgtctcagcatgcttgtggttgcaacatctgggactgggtttgtcttggggagtggtagtgctgttgatctttcggcactttcttgcacttgcttgggtaccatgatggttgctgcatctgctaactctttgaatcaggtgtttgagatcaataatgatgctaaaatgaagagaacaagtcgcaggccactaccctcaggacgcatcacaatacctcatgcagttggctgggcatcctctgttggattagctggtacggctctactagctacgcagaccaatatgttagctgctgggcttgctgcttccaacctaattctgtatgcatttgtatatacacccttgaagcagattcatcccataaatacatgggtgggagctgttgtcggtgctattccaccacttttgggatgggctgcagcttctaatgatatttcactaaatggaatgattcttccagctgctttgtatttttggcaaataccacattttatggccctagcctatttgtgtcgtgatgactatgctgctggagggtttaagatgtactctcttgctgatgcatctgggcatagaacagcattggtggctttaaggaactctatatatctaatccctttggggttcttggcttatgattggggtttgacttctggatggttttgtcttgagtccgctgcacttacacttgcaataagcgctgcagcattttcattctatagaaaccgtaccaaagaaaaggcaaggagaatgttccatgccagtcttctttacctccctgtgtttatgtctgggcttttgattcaccgtcgttctgaaaacgaacaattcttagaagacaaagcaaagggttttgtgaaatctgcatcctctacggagtcttcagagttggatgatgataacggcgatcaaaatatcaaggccaggcgtccctatcggactgaagcgcgtcctcccgtatcgtatgcctctgttgcaccttttccctttttgcctgctccatcatataacttcccttgatatctgtcagttatacggattttgtatgacttcaacattttctcggccaagttttgtttggttaagttgatatattcattgaaatgatacattctaatttgtctgtttaagccgttaaggttgttttatgtgccacaataaaaattgaagatgcatctgtaatctg

SEQ ID NO: 7953 - DNA, 1196 bp, Glycine max
cgagaagacgacagaaggggatacacacacagaaagaagaaccaccaagaaagaagcataggggaaaatacatcgatagagagaagttgaagggtgctacgtccttctattgtattaatgattgaaattcgtgtgggaattgtcttgttggtgtggtagagataataagagaggatcatagtagtgctggaaattgaagtgtgtaatagaatagtgatagagagagagagatatggggagaggaagggtgcagttgaagaggatcgagaacaagatcaataggcaagtgacgttctcaaagagaaggtctggtttgctcaagaaagcacatgagatctctgtgcattgtgatgctgaagtggccctcatagtcttctccaccaaaggcaaactctttgagtactccagcgatccctgtatggaaaaaattcttgaacggtatgagaggtattcatatgcagagaggcagcttgttgcaagtgatcaaccactaactgaaaattggactctggaacatgcaaagctgaaagcaaggttggaagtcctacagaaaaatcaaaggaattttatgggacaagatttggagggcctaagtatcaaagagcttcagaatttggagcatcagcttgaaagtgctctcaaacacattagatcacggaagaaccaactgatgtatgaatctatttcagagcttcataaaaaggataaggccctacaagaacaaaacaacactctcgctaagaagataaaggagaaagagaaggcactagcccaacaggcacaactggagcgacttggtgatgaagtggatctgacttcctctgcccttgttccccaaccactggtgacatcaaacattagaacctcctcacaaatcagaggtgaaggagataacgaaggaaccccaactccaacccaagctaatgccattcttccaccttggatgcttcgtcctacaaatgaatagaatactatttaattaatgacataaagttttaatcaaattaaatatgaatatggccaatacaaagctcaccctacaagatgtaaaatggtctagtgtgtcgatttgggaatggcacccggtgacttgatcagttggaatatcaacgatatgtaatatgtctgtgactaccacatttcaaggatgcttagtaaattatatggtatggcctgtctatacaggcctacaatac

SEQ ID NO: 7954 - DNA, 1819 bp, Glycine max
acgacagaaggggatcaacttctaccgttctacatagcatctcctttaccaccattctagatatcagagaactctgcagctctcttaggtttttaaaaaacaccacgcaaacagcaagatggccacttccgacagtaacatgctactaaattatgttccagtttatgtgatgctcccactcggagttgtcaatgttgacaatgtttttgaagacccagatggccttaaagaacagctcttgcagcttcgagctgcgggtgttgacggggttatggttgatgtgtggtgggggatcatagaactgaaggggcctaagcagtatgattggagagcctacaggagtttgtttcagctggttcaagaatgtggcttgacactgcaagctattatgtcattccatcaatgtggagggaacgtaggagatatagttaacatcccaattccccagtgggtgcttgacattggagaatcaaatcatgatatcttctacaccaaccgctcaggaacccggaacaaggaatatctaactgttggtgtggacaacgagcctatattccatggaagaacagccattgagatatacagtgactacatgaagagtttcagagaaaacatgtcagattttttagaatctggacttattatagacattgaagttgggcttggcccagcaggagagctcagatacccctcttatccacaaagccaaggatgggaatttcctggtattggcgaatttcagtgctatgacaaatatttgaaggcagatttcaaagcagctgtagcaagggctggccatcctgaatgggaactgccagatgacgcaggcaagtacaatgatgtcccagaatctactggattcttcaaatcaaatggcacgtatgtcactgagaaagggaagttcttcttgacctggtattctaacaaattgctgaatcatggtgatcaaatactagatgaagccaacaaagctttcctgggctgtaaagtcaaattagcaatcaaagtatctggaattcactggtggtacaaagttgaaaatcatgctgcagagcttactgctggatattacaaccttaatgatagagacggataccgccccattgcaaggatgctgtctcgccatcatgccattttgaactttacatgtcttgagatgagggactcagagcaaccctcagatgccaaaagtggaccacaggagcttgttcagcaggtattgagtggaggttggagagaagacatcagagttgctggagaaaatgcacttccaaggtatgatgccacagcttacaaccaaatcatactgaatgcaagaccgcaaggtgtcaacaacaatggccctccaaaactaagcatgttcggagtaacataccttcgtctatcagatgatctactgcaaaaatcaaattttaatatattcaaaaaatttgtgctaaagatgcatgcagatcaggattactgtgcaaaccctcaaaagtataatcacgccataacaccattgaagccatctgcaccaaagattcccattgaggttcttctggaagcaactaaaccaacactgccattcccctggcttccagagacagacatgaaagttgatggttgatttcccaatttggtgccatgagtaattaaataatctgctggaaataatatctaccaatataaataaagcatccagccactgtaatctgcaatgctgataataatgccatgaagtagcactgcctaaacatctacaaagtactctcgtgtactttttatgtgtgtattcctatcacgaagttaataaactattttatcaaatgaatatcgt

SEQ ID NO: 7955 - DNA, 1161 bp, Glycine max
gagagagagaaactgagagaaattcgcaaaccctaatttcggaaagatcggcgatggctgcctccaaggatcgcgagaacttcgtctacatcgccaagctcgccgaacaggccgagcgatacgaagagatggtggaatcaatgaagaacgttgcgaatctcgacgttgaactgactgtggaggagcggaatttactttctgttgggtacaagaatgtgattggtgctcggagagcatcgtggaggatcctgtcttccattgagcaaaaggaagaaacaaaagggaacgagttgaatgcgaagcggattaaggagtacaggcagaaggttgaattggagctttcaaacatctgtaatgatgttatgacagtgattgatgagcaccttatcccttcggctgcagctggtgaatccactgtgttttactataagatgaaaggagattattatcgttatcttgccgaatttaaggcaggcaatgagaagaaggaagctgctgatcagtctatgaaagcatatgagtctgctaccactgcagcagaggctgatttacctccaacacatcccatccgattgggtctagctttaaatttctcagttttctattacgagatcttgaactctccagaaagagcctgtcatcttgcaaaacaagcttttgatgaagctatttctgagcttgacaccttgaatgaggagtcatacaaagacagcaccttaatcatgcaacttctcagggacaacctaactttgtggacttctgacatcccagaagatggagaagatgcccagaaagtgaatggcactgccaagcttggtggaggtgaggaggcagagtgagtccgattgttgatgggatcttccttaggattcgatgcatgcgtttgggaatgaaacatgagggccgttacttatccgtgtattagctagagatagggttccattgttttctctttgtttcttgttgattgccccatacttcccgataggggaaagagatactccatttgtgctatatttatggtatgtttttatttgtgtggtgtctggaaatggcctatttcattcccaatccttttcctccagtctctgggggatttgattgatgagaattgcttatggtgtatttccttttccaatgaaatgctacaacctttactgc

SEQ ID NO: 7956 - DNA, 843 bp, Glycine max
ggacacaatcaatcccattattaaagggataagccttcaaccttgcaacacaacactacaacctaaggtctgcactacgagaatgtctcagggaagaggcagtgcatctttacctattgtggtcactgtggtttcactactgtgccttttggttcttttggaacgtgctgatgcagcaacttacaccgttggaggacctgggggatggaccttcaacactaatgcttggcccaaaggaaaaagattcagagctggtgatatcctaatcttcaattatgattcaacgacccacaatgtggttgctgtggacagaagtggatacaacagctgcaaaacgccagggggtgctaaagtgttcagttcagggaaggaccaaatcaaactagcaagagggcagaactacttcatatgcaactaccctggtcactgcgaatctgggatgaaagttgccattaatgcagtgtgatggtgcttaatacttcttgagttgaagtgaaaattaagttaatggtcaattagctagcattagtaaatgttagtgtgtgctcatgtatgtactttttttatatgaagctgttatatatatttattaatcactatagttttgtgaagcaaagtgggagtgagctggcttggtagatcaattgttcctatgtttggtatgtgttgtgtagtgggagtataaaaatggtccattagtcacgggctcttcttattagacattggatctacatattttgaagttattgaaagtctcagagccaattatctgtatctgtgtgtcggtgtcacagtgtatggttctattactgattttgtttgcttcaataaattaaatttcct

SEQ ID NO: 7957 - DNA, 1018 bp, Zea mays
actgctcacgtcacgtgccgcccgcgttctctctccgactcccatgcctctccggtgagctagtctggtatccatcggcgagctagttttgtctccaccggcgagcacgcgtctgtaacctcctccacccccatcgaactcctcctgctctccaatccgctagatctcggctccgtgcaggttgcgtggatggctgtgtggtgttgctttgctcgctaatttggttggatcaggagtgtcctgggagctatgctatgctgattgtgaggaatttggtagcacctctatcagggtttttaaactagagtgctgccgccccagcatacataatatggacgaagaaaatgttgttgagctgctgcaacgttatcgccgtgaccgtcaagtattactcaactacattctttctggcaacttgatcaagaaagttgcaatgccacctggtgcaatctctttggatgatgtagatatagatcaagttagtgttgattatgtcctcaactgtgctaagaaaggtgaacctcttgaccttggagacgccatccgcctttttcatgatagccttgactatccatatgtgaataacactggagctgtggatgagttctatttgcttacaaaaccagaatattcaggaccagctccaacacgagaaccaccacctatcccagccactgcaccatcatcagttgtggtaccaccaccggatgtggaaccagcaccaattattgtgtcatcgccagtcacagctaccaacttgccaaaatcacaaccatttgattctccgaccgagaaggagttaactatagatgacattgaagactttgaggatgatgaagatgaatttgatgggcgaagggcttctagaagacatcaaactgacgccagtgatctatcgttgctgttaccactatttgaaacaggtatcacagataatgatcttcgtgagacagcatatgagatccttgttgctgctgctggtgcttccgggggtcttatagttcctcagaaagaaaaa

SEQ ID NO: 7958 - DNA, 1659 bp, Zea mays
cgcgcccgcctgccccaacatcccccctccccgctccgctccacgcacggctccagatctgctacggcggcggccggtggacgccgcgccgcgcgtgccggaggcggtgacgtgagcggcggatcctgcccggccgtgccatcctggcgacgatgacagcgtaagcgggcggcggacgaccgcgcccccccggcccctactcccgaggtcattggcgtgtgctccttggcagaaaatggcgatgatggtggatccccccaatggcatggcaagtcaaggaaagcattactatactatgtggcagacactgtttgagatcgacaccaagtacgtgccgatcaagcccatcggaagaggagcttacggaatcgtttgctcatctgttaaccgcgagaccaatgaaaaagtcgcgataaaaaagataaacaacgtctttgacaaccgtgtggatgcgctaaggacgctgagagagctgaaactccttcggcacctgaggcacgagaatgttattgctctcaaggacataatgatgcctgcgcatagaaggagcttcaaggacgtttacttggtttatgagctcatggacactgatctgcatcaaataattaagtcatctcaaccactatccaatgaccactgccagtatttcctttttcagctgctccgaggcctgaagtacctccattcagccgggatactccacagagacctaaagccagggaacctcctggtcaacgcaaactgtgacctgaagatatgcgacttcgggctcgcccgcacgaacaacaccaagggccagttcatgacggagtacgtggtgacccgctggtacagggcacccgagctgctgctctgctgcgacaactacggcacgtccattgacgtctggtctgtggggtgcatattcgcggagctgcttggccgcaagccgatcttcccaggaaccgagtgcctgaaccagctcaagctcatcgtcaacgtcctcggcaccatgggcgaggccgacctcgcgttcatcgacaacccgaaggcccgcaagtacatcaagtcccttccgtacgccccgggcgcccccttcaccggcatgtaccctcaggcgcaccctctcgccatcgacctgctgcagaagatgctcgtgttcgacccgtccaagaggatcagcgtcaccgaggcgctggagcacccgtacatgtctccgctctatgacccgagcgcgaaccctcccgcgcaggtgccgatcgacctcgacatcgacgagaacctcggcgtcgacatgatcagggagatgatgtggcaggagatgatccactaccaccccgaggtcctcacgagaatcagcatgtgagtatgtgatgtgaccagacaggcagcaatgaaacatgtggacagaggtctgctgcgccaggatcatcacatgttcgcccttcttacgagcttaactgcgattacggcaccgagtcgaggtatcactacatgtatcggaaccgtcaggcggtctcttgtgtaaatatgcgctgaataagatgtgtggcaatctcttgttttttggttgtacatggacctcgctgttgtacgagtctgtgaagtggaaccctggtactaagacctgtaatttcagaccctaatctgttgtatggaaatctgaaggccttgactccc

SEQ ID NO: 7959 - DNA, 700 bp, Zea mays
caccaccttctagctgggcgaaagagcatacgcggagcagaggcgcacccccgcggagcagaggagaagaaggcgatgcagacgagaggggattccaagatgccgagggccaccagcgacgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttcactgaggtgtgctgc

SEQ ID NO: 7960 - DNA, 673 bp, Zea mays
aatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgctaggttcctcaaggcgggcaagtacgctgagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcgatcggggaggagtcgggtatgctgggaaggagaattagattagtatctgtttttttgaatgggatgtgaacgtggctgtgaatctcaggattgtatgctcgttgagaaagaaatggaaggacttcgtgatgcacgatgttgatgcc

SEQ ID NO: 7961 - DNA, 1239 bp, Zea mays
caacagtgtgcgtcttgtgccgcaggggcgtgggccttcttcctcctcttccggcactccactgctccgtctcccggcctctcgcctctcggcctctccatcgttcgacctcgcgacgcgtcaagtaggggggcggcggccttcgcggagatgaccaccttcctgatcaccggaggcgatttcccgcgacactcctcccccctccccgtgctctgctagacagatagatccgggctcttccttgatttgttcggtgaggacatcatgtggagttttgcatcaaatgccatagctggaagcttaaagaaaaaagcacaaccctcaaaatgcagcatatccaatgcagattattctgatgatgaagtttcttcatgtacaagcagagaggaaggccttgattgtccaatatgctgggaatccttcaacctcgtggagaatgttccctatgtcttgtggtgtggccacacaatgtgcaaaaactgcatccttggtcttcactgggcagttgtcaagttcccgtcccttcctatccagctgcctttgttcatctcatgcccctggtgcaacctgctgtctttccgcctggtttacaagggcaacctcaggttcccacgcaagaactactttctgctctggatggtcgagagcatgaacggtgggagagcaaaattccattccactaaccatgacgagcatcattccacgtggcattcaagtgccggcacaagctccagccatcaacagcgaagaaatgctgctgtaggatcagagagctcttctggcagagagacaggcgtaggccgcaacattttccacaccgacaacattagtgcttctctgcaaaagcttatggtgtgcttcatgcagctgacggccaagttcccactcgtgataatctttctgctgatagtcctttatgctgtccctgcaagtgctgctgttctggttctctacgcccttgtcacgtttttgtttgcactgccctcatttttgatcctctactttgcctaccccagcttggattggcttgtcagagagatcttcgcttaattcgtgctgtctgaaatgtccgcgcagtttgtatccctgcgacaaatgatatatatcggtatatgtattccatgggccacctgccctcgtaggccctgtatagtttcttcttattctctgtccttgtagcactctatttctgttgtaactaacagcttattaaaaatgctctgcaatgcttttatttgc

SEQ ID NO: 7962 - DNA, 938 bp, Zea mays
ggaagtttcattttatatgccaaagtacgattgggtgcccgtttggcgagggatgtcattttctgcactttgtccctggtggttacccggcagttgcaaaaatgctgaatctaagtagctctgctgtatctgtgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggaggaggccgaggcggtggtccagggggcaagagcagcaactacaagacgaagctgtgcgagaacttcttgaagggtgcctgtacttttggtgaccggtgccacttcgcccatggcgagacggagcagcggagaggtgctgcatgagagtcgaggtgctctaggcaatgagatgccctgtgctctctccttttgctactgtgaattttcgccttgcagcgctaggcggttggactgttgtgttgtgttgcgacgtcaatggattaaactctagatttc

SEQ ID NO: 7963 - DNA, 787 bp, Zea mays
gtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 7964 - DNA, 1059 bp, Zea mays
tcatcgcagagaggacagcagcacctgagattgacggcggggcagcgcgcgggcccttcccttcggagcactcagcgtgagagatggggaggcagccgtgctgcgacaaggttggcgtgaagaagggcccgtggacggcggaggaggaccagaagctcgtcggcttcctcctcacccacggtcactgctgctggcgcgtcgtccccaagctcgcagggttgctgaggtgcgggaagagctgcaggctgcggtggaccaactacctgaggccggacctcaagaggggcctgctctccgacgacgaggagaggctcgtcatcgacctgcacgcgcagctcgggaacaggtggtccaagatcgcggcgcagctaccgggcaggacggacaacgagatcaagaaccactggaacacacacatccgcaagaagctcgtccggatggggatcgaccccgtcacccacctgccgttgcaggaaccgccggctcctgctcctgctcccgccgagcagcaggagcagagccacaggcagcaagaagaactgcaactgcaagagctgcagaacggccgcgagcttatcatgcaggagggcgcgggggaagacgatatcacgccgatgatccagccgcacgagatcatgccgacggcggcagcggcaagcaactgcggctctgtttcctctgcccacgccggctccgcgtccgtggtctcgccgtcctgctcctcctcggcggtgtccggcgtggagtggccggagcccatgtacctgctcggcatggatggcatcatggacgccgactggggcagcctcttccccgacactggcgctggcggcggcggcggcggcttcgacttgggcgtcgatccgttcgaccagtacccgggcggtggcttcgaccaagaagacgaccacagaatatgacatcggcctagcaatgcacatagattcgccgcttctccttccatctcgctcagcacatcagcgccgtagcctccatgttttcttaatagctctccagggtccagtgctgataaacaagaactgacaaattcgggtgcgg

SEQ ID NO: 7965 - DNA, 871 bp, Zea mays
ggagtcggagggaaccgaaaactcaggtgagggcttcttccgccgcacccgccgtcttatccgaactcctcgacccgattggcgcgattcgccgtttgttttcccgaatcggcgacgggatccgcccgattcggccgtcgatctgcgctgattcggcccgcgcgccgtcggggttcgctttcttctgcgcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttctggagctggctgggaacgctagcaaggatctgaaggtgaagcgtatcacccctcgccacctacagttggccattcgcggagacgaggagctggacaccctcatcaagggcaccatcgcaggtggaggtgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacattgtgtttgtgttgagttgttaacttcaagggtgcaaacctggataattatttagttattatatgactatctggtattcggtt

SEQ ID NO: 7966 - DNA, 1048 bp, Zea mays
cctagccgcctgaggccgacgccaaatctctcctgaccgcaacggggaactcgacccccgcctccgccaccgccaccgcgccggtcgccgacccactcagatgaacacgtctccgtccagatacagggcaatgatgggaggctgggggggttcggatgggtacgagggatcaaagaggacgcgaatgatgatggaatcgaatccctacttcgcagtgaacgcagggagcccactggatgtctcaaagagggccaggatgatggaaccaggtgctccctattttggggctatgggaagcagcgccagcggtgccggcggcggcttctaccagccctttaacagcaacctagctggtgcagggtctagcaccggtatccaaagcttcccatgtgtccggctgcgaggccttccctttgattgcaacgacattgacgtctgcaagttctttgtggggctggacatagtggactgcctcctggtcaacaagaacgggcgcttcaccggcgaggctttcgtggtcttcccaacatccatgcaggcagagtttgcgctgcatcgcgacaggcagaatatggggcggaggtatgtcgaggtgttcaggtgcaagaagcacgagtactactgcgcaatagccaatgaggtgaaccagggcggttatttcgagccggagtaccgtcgctccccgcctcctccgaggcctaggaagccgtctgaagataagggcagcatggagtacacagaggttctgaagctccgcgggcttccctactctgccaccactgaggacatcatcaagttcttcctggagtacgagctggcagaggagaacgtgcatatcgcctaccgcaccgatgggaaggccacgggtgaagccttcgttgagtttccgacagctgaagtcgcgaagacggccatgtgcaaggataagatgaccattgggacgaggtacgtggagctgttcccgtcgaccccagaggaggccagcagggcgaaatcccgaggcaggcattgaagaaacgtgttccagtgatcttctgtatgcatgcat

SEQ ID NO: 7967 - DNA, 1445 bp, Zea mays
gttttcatcctccttgaagcgaaaacgatcgagcttactgtatcgcaggcatttcggtacactacgttctccggctgtgtagagctgcgcagatgggtgccgagttgggagaagcgggtgtccctgcccgggacatggtggacgcgctggaaggcgtgcgctccatcctgctgaaaccgtcggagcgcctcgacgacaagcgcttcacgaggatcgccggcgccgacttcgacgacgccggcctcggcctcgccgggttgctcggctcgctcgcgtccacggggttccaggcctccaacctcggcgacgccatcgacgtcgtcaaccagatgttggactggaggttgtcccacgagaagccaagcgacgattgcgctgaagctgaactcgatcctgcgtacagagaatccgtcaagtgcaagatattcttggggttcacttcgaaccttgtgtcttccggtgttcgggagatcatccggttccttgttcagcatcgcatggtggatgttgttgttacgactgctggaggtatagaggaggacctcatcaaatgccttgcgccaacctacagaggcgacttcactctgcccggagcgctgctgcggtccagaggacttaaccggataggaaacctgctggtgcccaatgacaactactgcaagttcgagcactggatcatgccgatcctcgacaagatgctgctggaacagtccacccaaaatgtttggacgccgtccaaggtgattgctcgccttggcaaggaaataaatgacgaaagctcctacctttattgggcgtacaagaacaacatccctgtgttctgcccagcattgactgacggatcaattggggacatgctgttctgtcactcggttcacagtccaggtcttgttgtcgacattgtacaagatgtacggctgatgaacgcggaaaccatccacgcaagcccaaggaagacagggattatactccttggcggaggccttccgaagcatcatatatgcaacgccaatatgctgcgcgacggagctgactatgcggtgtatgtcaacacagctcaggagttcgatggcagtgattccggggcgcggcctgacgaagcggtttcatggggaaagatcaagagctcagcgagaactgtgaaggtgcattgtgatgcgacgattgcctttccacttcttgtggctgcaacatttgcacgcaaggttcacggcactaaatcaacaaactgaatcggaggcagtgaaattaaaatatggcgctctataactagctgaaactttcctcatatgatggttgagcttgaagcatgaacttttatttgcttgaagggtgtctatctcttagctcgtttactgtttatacattactgtaacatatgtatgatatatattcatttgaaaccatttgggttattatcatacaataaaacttgtgtgtacgag

SEQ ID NO: 7968 - DNA, 865 bp, Zea mays; identical to SEQ ID NO: 2702

SEQ ID NO: 7969 - DNA, 734 bp, Zea mays
ccaccctcggcgactccaaggagaggctctgcggcgccatccagctctccaacctcttcggcatcggcatcggcgtctccattgccgcctccgtcagcatgcaggcgatccggagggccggctgcttccactaccgagggcacgaggacccgtgccacgcctccaccagcccatacatcgccgtcttcggcgtcatgcagatcgtcttctcgcagatccccgacctagacaaggtatggtggctgtccaccgtggccgccatcatgtccttctcctactccaccatcggcatcttgctcggtgttgttcagattgtagaacacggaggaccgagggggagcctcgccggcgtcatcggtgctggcgccagggtcaccatgatgcagaaggtgtggcgcagcctgcaggcttttgggaacatcgcgttcgcgtacggtttctctatcatcctgctcgagatacaggacacgataaagtccccgccgccgtcggaggctaaggtgatgaagaaggcgacggcagtgagcgtggcggtgaccacggtgatctacctgctgtgcggctgcgtcgggtacgcggcgttcgggggcgcggcgccggacaacctgctcacgggcttcggcttctacgagcccttctggctgctggacgtggccaacgcgttcgtggtggtgcacctggtgggcacctaccaggtcatgtcccagcccgtcttcgcctacgtcgagcgccgg

SEQ ID NO: 7970 - DNA, 911 bp, Zea mays; identical to SEQ ID NO: 1736

SEQ ID NO: 7971 - DNA, 1439 bp, Glycine max
catcaagttactatctataattaattaaattcctcgtggaatattgaagaagccatgtctacagctgggcaggtcatcaagtgcagagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatctt

SEQ ID NO: 7972 - DNA, 2067 bp, Glycine max
agattgttgaatcatcacatggctgtgacaaaagagaaagaggatgttcggaacactgggaagagattgaaatgcatgaggaatgaagaagaagaagtttatgaagaagaagagagtgagcttcctttaaagccaggatttttcttctacccaacaacacccacttcctttgttgtatctgatgctcttgaacccgattttcccatcatatatgtcaacaaggtctttgaaatctccactggatatcgtgctgacgaggccctcggtcgcaattgtcggttcttacagtatagagatcctcgagctcagaggaggcaccctttggtggatcctgttgttgtgtctgagattagaagatgcctcgaggaaggtgttgagttccaaggtgaacttctgaatttcagaaaggatggtactcctttggtgaacagactgagacttgcgccaattcatgacgatgatggaactgtgacacatgtgataggtatccaactcttttctgaggcaaatatagatctgaaccgtgtctcatatccagtcttcaaagagacttgcaatcaagattttgataagactggtaaatataatcctaagagtggacaatcattgtacagtcagcaccaagagatgtgtggcattcttcagctttctgatgaagtcttggctcacaacattttgtcacgcttgacaccgagggatgttgcatccattgggtctgtatgcaggaggatccgtcaattaacaaagaacgagcatgtcaggaagatggtatgtcaaaatgcgtggggcaaagaagtgacgggcacattggaactgatgaccaagaagttaggatggggtcgtctgactcgggaacttaccactctcgaagctgtttgttggagaaaactgacagttggaggtgcagtggagccttcacgctgcaatttcagtgcttgtgctgcaggaaaccgacttgtattgtttggaggtgaaggagtggatatgcaacctatggatgacacttttgttctaaatcttgatgctaaaaatccagaatggcgcagggttagtgtgaaatcatcccctcccggaaggtggggccacacgctctcatgcttaaatggttcttggttggtggtttttggtgggtgtggtaggcagggattgctcaatgatgtgtttgtgcttgatttggatgctcaacagccaacatggagggaggtttgtggtggaacaccaccacttcctagatcatggcatagctcttgcacaattgaagggtccaaattggttgtctccggcgggtgcacagatgctggggtacttcttagtgacacatatttactggacctcacaacagataatccaacatggagagaaattccaacttcatgggctcctccttctcggttggggcactcactctcagtctatgggaggactaagattctaatgtttggaggacttgccaagagtggacacttgcggctacgatcaggcgaggcttatacaattgacttagaagatgaacaaccacaatggaggcaactagaatatagcgcattcacagggttagcgagtcaaagtgctgttgttcctcctcctaggctggatcatgttgctgtcagcatgccttgtgggaggatcattatatttggaggttccattgctggtcttcactcaccatctcagctctttctgttggacccctctgaagaaaaaccatcctggaggatcctcaatgttcctgggcaaccgccgaaatttgcttggggtcatagcacttgtgtggttggagggacaagggtgttggtgttgggtggacacactggggaggaatggatactgaatgagttgcatgagttatgcttggcaagtcgacaggactctgacctgtgaagtgcataaaaccagaccctcttctctcaagacaagattttggttgcaaaaaggttttgggtggctttcctttagcagtttggtttttgtatatgagccactattacatgattgttatatgaaatgacgtgtgtattaccagtgtttttgaatgatatatgatgtcatctggctcctctgtaaaaa

SEQ ID NO: 7973 - DNA, 1465 bp, Glycine max
accaagacgaggatgaggagcaagacaaagagagccaagaaagtgaaggttctgagtctcaaagagaaccacgaagacataagaataagaacccttttcacttcaactctaaaaggttccaaactctcttcaaaaaccaatatggccacgttcgcgtcctccagaggttcaacaaacgctcccaacagcttcagaatctccgagactaccgcattttggagttcaactccaaacccaacacccttcttctcccccaccatgctgacgctgattacctcatcgttatccttaacgggactgccattcttaccttggtgaacaacgacgaccgagactcttacaaccttcaatctggcgatgccctaagagtccctgcaggaaccacatactatgtggttaaccctgacaacgacgagaatctcagaatgataacactcgccatacccgttaacaaacccggtagatttgagagtttcttcctatctagcactcaagctcaacagtcctacttgcaagggttcagcaagaatattctagaggcctcatacgacaccaaattcgaggagataaacaaggttctgtttggtagagaggaggggcagcaacaaggggaggagaggctgcaagagagtgtgattgtggaaatctcaaagaaacaaattcgggaactgagcaaacatgccaaatctagttcaaggaaaaccatttcttctgaagataaacctttcaacttgagaagccgcgaccccatctattccaacaagcttggcaagttgtttgagattaccccagagaaaaaccctcagcttcgggacttggatgtcttcctcagtgttgtggatatgaacgagggagctctttttctgccacacttcaattcaaaggccatagtggtactagtgattaatgaaggagaagcaaacattgaacttgttggcattaaagaacaacaacagaggcagcaacaggaagagcaacctttggaagtgcggaaatatagagctgaattgtctgaacaagatatatttgtaatcccagcaggttatccagttgtggtcaacgctacctcagatctgaatttctttgcttttggtatcaatgccgagaacaaccagaggaacttccttgcaggttcgaaagacaatgtgataagccagatacctagtcaagtgcaggagcttgcgttccctgggtctgcaaaagatattgagaacctaataaagagccaaagtgagtcctactttgtggatgctcagcctcagcagaaagaggaggggaacaagggaagaaagggtcctttgtcttcaattttgagggctttttactgaataagtatgtagtactaaaatgtatgctgtaatagctcatagtgagcgaggaaagtatcgggctatttaactatgacttgagctccatctatgaataaataaatcagcatatgatgcttttgttttgtgtaaaaaaa

SEQ ID NO: 7974 - DNA, 1599 bp, Glycine max
gttgtaaaaaagattcatgttcagttagtatcttgtgaaggcgatcgaatactagaaagaaacaaatcgatcaagcttgaaagataggaagaatttaagaaatgggtgaggaggaaatagatgattctcccttgattcaaggttttccttccggcgacgtgccatttaggagaactggtaatgtagagagggcagtagcacatataataactggtgtgataggggcaggggtgctgtctctagcatggtctgtggcacagttagggtggattgctggtccttttatcatcatagtctttgcaggaacaacctttctttcagcaaaccttctttctgactgctacagattccctcatcctctctatggcaacattaggtgcccctcctacattgatgctgtcaaggtttacctaggagactcaaggcaaaaggtgtgtggagtgctggtgcatgcgagcttatatggtgccaccacggcctatgtcattacatctgccaccagcatcagagcaatactgaaatcaaattgttatcacaaggaagggcatcaggctccttgtaaatatggggatgcagtatatatgatgctgtttggactagttcagatcataatgtcattcataccagatctccacaacatggcatgggtttcaattgttgcggccataatgtcctttacatactcatctattggacttggacttggcatcacaacagtaatagaaaatggaagaattatgggtagtttaacaggagtaccggcttcaaatattgctgacaagttatggttagtcttccaaggaattggtgatattgcctttgcctatccatacacagtcatcctccttgagatacaggacactctagagtctcctccaccagaaaacaagaccatgaaaaaggcctccatgattgctatcctcattacaacattcttctacctctgctgtggatgctttggatatgcggcttttggaaatcaaacaccaggaaacctcttgacagggtttggattttacgagccttactggctcattgactttgccaatgcttgcattgttcttcacttggtaggaggatatcagatttacagtcagccgatatatggtgctgttgacagatggtgttcaaaaagataccccaacagtggatttgtgaataatttctaccaattgaaactgcctcggttgccagcttttcagctaaacatgttcaggatatgttttagaacagcttatgtggtttccacgactggacttgcgatcctatttccttacttcaatcaagttataggagtgttaggagccttaggcttttggccattggctatatatttcccggtagagatgtactttgtgcagaggaaagttgaagcttggtctagaaaatggattgtcctcaggaccttcagctttatttgctttctggtgtcattactgggtctcattggatcacttgaaggaatcataagcgagaaactaagctaatgaagggtgcttcatttgtttgagtttaatgtcttgttgctcatatcttccatgtaattcagtttcatgctaattctattactattgagagttaataaaggggataccaatt

SEQ ID NO: 7975 - DNA, 1517 bp, Glycine max
caacatgcgactttgtttttttaacgatgaaaacgaagtgtattgagtaatactccgttccctggttcctccatcgcgaaattagggttcgctcacttgtcttcaatttcccagattcacctagcaccatccataaatccccctattaacgtgtctttcggaccgatttttctacgtgacgcatcgcaattcttcagcggtttcgtttagggaacccgcgaaaccgaatcagatagtgcggcacggaaactaggaattaaagcaatggcagaagatctggtgctggatactgcaatcagagactgggtgttgatccctctctctgtggttatggttctcattggtgtgctccgttactttgtttctaagcttatgcactcttcacaaacccctgatgccaaaattgttaaagaagggcaagtgattgttagagctcggaatttacgtgctggggcgaatttcattccatccaaggcatttcgcgctcgcaaaatttatttctgtaacgaggaaaatggtctgttgtttgttccaaagggccagggccagaatccgcaagcacagatgttctctgatccgaacatggccatggatatgatgaagaaaaacctttcaatgatcattcctcagactcttacttttgcttgggtgaactttttcttttctggatttgtagcagccaagataccctttccattgacacagaggtttaggtcaatgctacagaatggaatagaccttagcaccgtagatgttagctatgtcagcagtcgctcttggtacttcctcaatctgtttggattaagaggattgtttagtctcatattgggtgaagaaaatgctgtagatgatacacaacgtatgatgcaaatgggtggatttggatttgatccttcaaagggtctgagtgctgagaaagacaatcttgacataacccagcatgactgggccttaccaaattttgagcagcgtgctgaagctgtgttgaggaaagttgccagttaaccatgttatggagtaggaagcttcattgctagcattagcaggatacacttactttctattgttgcggtaggaggtgtacctttttgcagaaaagatatcaaagatcttgttgagactgtagtcttgagactgaacattttgcaactatcagaaaacattgttcggttttgttgaagctagaactgaaactattcattcttgcttatttttctgaatgaccattgccataaaaagcatgaaggcttcccaggaaacgttgagtcctgtaatgtgtttcaaggcctattcaactattctatctgtatcccacatcccactcctagaattgtcccctaatatgttaaattaagaaatattacattcgcatctcttattctgcttttgttgcagaattagaatgcaggtgaggtgcacttgattataatcagatgctaaaaaattgtgatgtgatgtaatgcatgctcaaattaccaaaagccgaaagaatgttttaaaatttgaattgagtgatt

SEQ ID NO: 7976 - DNA, 1629 bp, Glycine max
cgcaaacgcaactcagctttccttcgatccctgaatctggacgttactaaagcagcccagccatccacgcaccattttaaaagccaacacagaaagcacagaaccaccacatcgttgccttcctctaaacgataaatttttgggattctgaaactagtgatacattttcttgcatgaaggcagcgtattgaggaattcagttagtgtattggaagatctagttcaacatgtcttctgtaagcaagggtgataggaaggcttccattgatgcagcatcatggctgttcaatgtggtcacgtctgtgggaattattcttgtcaataaggccttgatggctacatatggttttagttttgctacaactttaactggtctccattttgccacgacaaccttgttgacactcattcttaaatcgttgggatatatccagacctctcatcttccattatctgatataatcaaatttgtcttgtttgcaaatttctccattgttgggatgaatgtgagtttaatgtggaactctgttggtttctatcagattgctaagctgagcatgattccagtatcttgcttcctggaggttgtcttggacaatgtacgatattcaagggacacaaagcttagtattgttttggttttgctcggcgttgctgtctgtacagtcactgatgtcagtgtcaatgcaaagggtttcatagctgctgtaatagcagtttggagcacagccctgcaacagtattacgtgcattttcttcagaggaagtattctattgggtcatttaacttgttgggccatactgcaccagcacaggcagcaagtttacttctagtaggcccctttatggactactggttgactggcaaacgagttgatgcctacggctatggtttgacatccacgttgttcatcattctgtcttgcactatcgcagtagggacaaacctcagccagttcatctgcattggtaggttcacggctgtaacgttccaagtccttggtcacatgaagactatcctggtcctgatcttaggattcattttctttggaaaagagggtctcaatctacatgttgttctaggcatgatcatcgcaatagcaggaatggtttggtatggcagtgcttcttccaagccaggggggaaagagcgtcgtagcttttccctccccaaaacacaagattatagttcactacctgtgtcctctgaaccagatacgaaggaatagaaaataatagaaactaattagagaaaaagtgatgaaacttctggtgaactgcatgaaaaaaatcaggtgcccattaggcgagctggttcattttctttataccaggagtgaattcccaattatttatagatcatggttatatcttttcttatgtgttaatgaattgtttgggaaagaaatgagaggaaacagcgttaagggatggaaaaatctacgttatgttcctttttttttatgacagaaaatgttactgttacttttatagtaaaagtttaattccatttttcccattagggttggttccgttgttaccttctactcatgacaactattagcatgtttggattacctagttatgaaatgttttactctataaaatacttttgaaagttttaaaaaa

SEQ ID NO: 7977 - DNA, 1117 bp, Glycine max
ggtgaaacccgacgacagagacccctactaccttgaccgtggttatgcacaaagaatccctgcaggaaccactgtctatttggttaacccggacaagaagaaagatctcagagtgattaaactcgccatacccgttaacaaacctggcaattttgaggatttcttcctatctagcactcaagaccagcaatcctacttgcaaggcttcagcgagaatattctggaggcttccttcaataccaaattcgaggagataaacagggttttgtttggtggagaggggaggcggcaccagcaagagggagtgattttggaactatcaaaggaacagattcgggaactgagcaagcgtgccaaatctagttcaaggagtactaattccttcgattatgaaccattctacttgagaggctcccaaatctcttccaacaactttggaaagttctatgagatcacccctgagaagaacccccagcttcgggactttgatatcctcctcaatactgtggatatcaacgagggaggtcttcttctgccacactacaattcaaaggccatagtgatactaatggttactgaaggagaagcaaacattgaactcgttggcctaaaagaacagcaacagggagaggaaacaagggaagtgcgaaagtatagagccgagttgtctgaagacgatatatttgtaatcccagcagcttatccatttgtggtcaacgctacctcaaacctcaatttcgttgcttttggtatcaatgctgagaacaaccagaggaacttccttgcaggttcgaaagacaatgtgataagacagatacaaaaacaggtgaaggagcttgcgttccctgctgggtctgcacaagatatcgagaatctaataaagaaccagagggaatcctattttgctgatgctcagcctttgcaaaaggaggaagggaagaaagggtcctttgtcttttgaatatgtatgcttaggagactaggagttcacagcgagcgaggaaagtatagggatatgtaactagaataacttgagatccacctttctactactagtaaataaaataaataaatcgagcaagatggttttgtttactatctgctaagcaattttgat

SEQ ID NO: 7978 - DNA, 1358 bp, Glycine max
tccatctacacttccttcatttccatccccttctctcttttaaacctcacgcacaacgaaatcgtgattctgttgttcttttgaaatggaaaacgctccggtggtgtgtaaggaagatgatcagatggatttgcctcccggatttcggttccacccgactgatgaagagcttataagccattacctctacaagaaggtcattgacaccaagttctgcgccagggctattggagaagtggacctcaacaagtctgagccttgggatttgccatggaaagccaaaatgggagaaaaggagtggtactttttctgtgtgagagacagaaaataccccactggcttgagaaccaacagggccaccgaagctgggtactggaaggccacaggaaaagacaaagagattttcagaggaaaatctttggttggaatgaagaaaactcttgttttctacagaggtcgagcacctaaaggtgaaaaaagcaattgggtcatgcacgagtacagactcgaggggaaattctctgttcacaacctcccaaaaactgcaaagaacgagtgggtgatttgcagggtgtttcagaagagttcagctgggaagaaaactcatatctcggggataatgaggttggactcttttgctgatgaattgggttcttctgctctgccacctctctcggattcttcgccttctatcggtaacactaaacctcttaatgatacggcttacgtgccctgcttctccaatccaattgatgttcaaagaaaccaagaaggtgtctttgattccttcaccaactctatctatgcggtttcttcaaatcctatgggcattcttcccagaatgccaccttctggctccttctactccactcaaggtgttcaagctgcgcctaatttggcatttcctggttctgtttacacccttcaggatcacaccatcctgagaaccttatgtgaaaacaatggttacaagccagagagggacatgatcagtgtttcgcaggaaacgggtctaactactgatatcaacgctgaaacctcttcaaattttgatatgggtaggaggccctttgagaatcacaatcatgcatctgtttctgttgccccattggatcttgatggtttgtggaattactaaaagtttaaataaaaggatcaattacagtgaatagtgaaattaaccccacttttgagctagaaggaagaggaaaaagaagagcctcggatgggattgatgctattgttgtttaatttctctgtatagattttatctaagacatgcatgtactgaagcatatgttgttaagtgtaagaaatgttgtggaatgaattaggctggtttggtctgttgacacttt

SEQ ID NO: 7979 - DNA, 1423 bp, Glycine max
taaattcctcgtggaatattgaagaagccatgtctacagctgggcaggtcatcaagtgcagagctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttctatcttttttttgtg

SEQ ID NO: 7980 - DNA, 1413 bp, Glycine max
attctccatcttttttcttcttcttgaatgtgcttctgttgccaaagtttggattgtcatttttctgctgcggtggcatgggaagcagggaagccactgtcaatagaaaccatagaagtggcaccaccccagaaaggtgaagtgcgtttgaggatcctcttcaactccctttgccgtagtgatgtttattggtgggatgctaaggaccagactcctctgtttcctcgtatcttaggccacgaagcttcagggattgtggagagcgtgggcgagggtgtgacacatctgaaaccaggtgaccatgcactcccaatattcactggggagtgtggtgaatgcacttattgtaagtctgaagagagcaacctgtgtgagctactcaggatcaacactgacaggggtgttatgctgagtgatggaaaaacaaggttctccaaaaatggccaacccatttaccacttcgttggaacctccactttcagtgaatacactgttctccatgaaggatgtgtagccaagattaaccctaatgccccacttgacaaagttgctattgtcagctgtggattctgcacaggttttggggctactgtgaatgttgcaaaaccaaagcctaataatactgttgctgtctttggcttaggagctgttggtcttgctgcctgtgaaggggcaagggtttctggtgcatctagaatcatcggggttgatttacttcccaatcgatttgaacaagccaaaaaatttggggtcactgattttgtaaacccgaaagatcacaacaaaccagtccaagaggtcattgctgaaatgactaatggaggagtagatcgtgctattgaatgcactggaagcatccaagcttcaatctcagcatttgaatgcactcatgatggttggggtactgctgtccttgttggtgtgccaaagaaggatgttgaattcaaaactaatcctatgaagttcatggaagggagaactcttaagggtaccttctatggtcactacagaccccgcactgacattcctggtgttgtggagaagtacctcaacaaggagttggaactagacaaatttatcactcactctgtgccattctcaaagatcaacactgcatttgatcttatgctgaaaggggagggcataaggtgcctcatctgcatggaagagtaaatcaatgatgaatgatgttccctgctgtgagaacaatgtttctgtgttatgtgaaaagagaattgaataaatttggcatgcaattcggttgttggattcatgctatatgagtgtgtaaagaggtaacggggggtgatgactttcttggtcattgtcgtggctttgtgacttctattgcaaatgttgtcttgtaactttgttgtattttcggcaatatatctatatgatatctatctttct

SEQ ID NO: 7981 - DNA, 1788 bp, Glycine max
ctacacaacaccaagaaatccaaatctaattccttatctcgtttgatatcctgatttctactctctcagtttccactctattgtatatctgtatatgtatgtatgtgatgaactgatgatatttgcatttgcttttatagtttgcttggtcaccaagtaacgacaaagggaaacagtttctagctttttcttggctgattgtaaataatctctctcttttctatattggatcatagctttctgcaccctcttcctcttaggttctcctatttttctctcttgtcgtggacctcaactttgtaggctcaccttagaaacaaaacttcttttctttttggcgggggtgagagttgctatcttattcctggtttcatctacaagacactaacatctttgttgtttttagtttcagaattcgttatactcacccacacaccaaaattctggtacaccatgattttttcaaggttttgtacgaatctaaaaggtatggcttttatagattctcaactttatcttgatcacacagtaaaagatctgaaatctgtgcaccttgtgaatcaaagctctataatttcttcctttctgtgtttctgtgagcacccttttctagttcctctccatttccatctctttaggaacttaattcaactaagtttttgtatgcttgtggcttgagatatggaattggaaaccatctaccctccttgttttatgccaaattcaaattggtttgtgcaagagagccacagcacagagtggactagagaagataacaagaagtttgaaagtgcccttgctatatatgacaacgacaccccagatagatggttcaaggtggcagctatgatccctgggaagactgtgtttgatgtgatcaagcagtatagggaactggaagaagatgtgagtgaaatcgaagccgggcgtgttccaattcctggctatcttgcctcttctttcacctttgagctggttgacaaccacaactatgatggatgcagaagaaggcttgcacctgtcagaggctctgatcaagagagaaagaaaggagtcccatggactgaagatgaacacagacgttttctgatgggacttttaaagtatggtaaaggagactggagaaatatctctcgcaattttgtggtcactaagactccgacacaagttgctagccatgcacaaaagtactacataaggcaaaaggtttctggagggaaagataaaaggagaccaagcattcatgatataaccactgttaatcttacagaaacttctgcatcagataagaacaagcctcagttatttaatgcgtctcctgtgcttgcaccacagcagaagctgaatagcatatcaaaggtacagctgggctggactagtagccactacaatgatggatcattcatggttttcaccccaaatagtgatgccttgtttgtgtcatcttcacctgatgtcacttctatggccctgaaaatgcaagggcaagatctctatgactgtgctttacatgaggcttatgccaaggtaaaagttccaggtttcagcatggctcctagagacttcaataatgaagctgtttttggtattcatgcactgtaatgccaaccctgatgatgttaaacaaagaaaattccacgtcatagatcattgttctgtaggattaatgtagatgaccataagctagctagctactttgttcatggttagtgaacaacctaaaagaaaactagaataatgtttcaatccttaaaaactgaatttggaatgaacttattttaaagtttt

SEQ ID NO: 7982 - DNA, 1031 bp, Glycine max
ccttgattgaagtattaaatattcctatataaatataaattgggggtcttgaaattcaaagccatatctgtgattcatcaaatttgtgtttccccgaccccgattgcaagcaatggacgccttcaattccttcttcgattcaagaaaccgatggaattacgatactctcaaaaacttccgtcagatttctccggtcgtgcagaatcacctgaagcaggtttattttactctgtgttttgccgtggttgctgcggctgtcggggcttaccttcatgtcctcttgaacattgggggttttcttactacagtggcatgcatgggaagcagcttttggttactctccacacctccttttgaagagaggaagagggtgactttgttgatggccgcatcactgtttcagggttcctctattggacccttgattgatttggctattcatatcgatccaagccttatctttagtgcatttgtgggaacagctttggcctttgcatgcttctcaggagcagctttggttgcaaggcgtagggagtacctgtaccttggtggcttggtttcttctggattgtccatccttctctggttgcactttgcttcttccatctttggaggctcaacagctctctttaagtttgagttgtactttgggctattggtgtttaggttacattgtagtagacacccaagaaatagttgagagggcacacttgggcgatctggactatgtaaagcatgccttgaccttgtttaccgatttggtcgcagtttttgtccggattcttgttattatgttgaagaattcgactgagaggaatgagaagaaaaagaagagaagagattgattttcttaccaatctgctcgattaacacttcacctcgcttggtctgtaatacataaaaacagccgtctatacagtgttttccactttttaagcttgctcctcctactgtgcagttaagtcgtttgtttaccaatagtacatgttgacatgttttgagctctctaataagagaaatgtttacattac

SEQ ID NO: 7983 - DNA, 1662 bp, Zea mays
cggtggcacgtgaggctgccgctaggaaactccggcctccgggttctctgttctccctttccttccgactttcccactgccgtgacgattttcacagcgaattctccggccggcgccgccccgtccgtccgtccgttcttccgataccgaactcgccagtcgccacagcgatctctctcgctcgctccgccgacgcagcgctcggcttcagctcgagaggaggaaatggccagcagcggctacgaagggatcctcctggggatggggaaccccctcctcgacatctccgctgtcgtcgacgagggcttcctcgccaagtatgatgtgaaaccgggcaatgtcattcttgctgaggacaagcatttgccaatgtaagtctcgttgcccctttagctccccttgcagtttgaaatgttggtcatcgatactagcttgtcctgaacggagaatgggaaacaaattcttgatgttgtcacattaagcacccatgagacggggagaaacatagtggactcgtaatttttatggccaggtatgacgaattggctagcaagagcaatgttgaatacattgctggaggagccactcaaaactctatcagggttgcccaatggatgcttcaaattcctggtgcatcaagttacataggttgcatcgggaaggataagtttggtgaggagatgaaaaaaaatgcacaagctgctggtattaatgcccattatcatgaggatgataatgctccaacgggcacatgtgctgtttgtgttgttggtggagaaaggtcacttattgctaacttgtctgcggcaaactgctataagtctgaacatctgaagaaacctgagaattgggcacttgttgagaaggcaaaatatatttacattgctggatttttccttacggtatccccggattctattcaacttgttgctgagcatgccgctgcaactaacaaggtgtttatgatgaacctttccgctccctttatctgcgaggttttccgtgatgcccaagagaaagctcttccgtacgtggattacatctttggaaatgaaactgaggcgaggacctttgctaaagttcgaggttgggagactgagaatgttgaggagatcgctttgaagatctcccaattaccgaaggcttcaggaacacacaagaggattactgttatcactcaaggttgcgatccggtagttgtggctgatgatggaaaggtgaaaactttccctgtgatcctcttgcctaaggagaagcttgttgacaccaatggtgcaggtgatgcgttcgttggaggcttcctgtcccagttggtacaagagaagagcatcgatgagtgtgtcagagctgcctgttacgccgccaatgttgtcatccaacgttctggctgcacttaccctgagaagcctgacttcaactagagccatttcagaatttagagtcttatggcatctggtctgtataattagtcgggttcgccttggtctgtttacggcacattctagtgtcaccgtacaggtcaaatgttcatgcgtgtaaggcgtgtcatactgtcatggcactctacaagtgcatgtgccagaaacgtgcatgcgtctctcggttacggactctttacagttgcatctaaaacaattcaaagcaccttgcggtgcatccttg

SEQ ID NO: 7984 - DNA, 1631 bp, Zea mays
aagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctat

SEQ ID NO: 7985 - DNA, 1342 bp, Zea mays
cgagcaacagagcagaagcaaagcgcagagctagcaagtgaccgaccgagagcaaataggcaaggcaacgcaggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcaacgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactcggacccggtggcgctcggccactacatggtgcagcagctcaacaggcatagcggcttgctctactgccacatggtggagccccgcattaccgcccacgggcgcaggcagatccctcacgggctcttgccgttccgaaaggcgtttcatggaacgttcatcgccgccggtgggtacgatcgggaggaaggcaacaaggtggtggcagaagggtatgctgacctcgtcgcgtatgggaagctgttcttggctaacccggacctgcctaggaggttcgagctggatgtggcactcaacaaatacgaccgctccaccttctacacgcaagatcctattgttggctacacagattaccctttctttgaagaagaagatggcaagaatgagaggtgaaatctgataatgtggagggttcatcaagtataagttcgtcattatttccaccattcattattggtcattgtggtggagtcattgtgtcatgttgtttcattctgtactagtgtggtgtgaagtgaaataaatctatttggtg

SEQ ID NO: 7986 - DNA, 1622 bp, Zea mays
tgcaccaattcctgaggcaccaaccaagcctctcttgttgactccgacgccgatcgacggccatggggacccaagcgccggagaaggagaactacccccctgaaaaggatgcgaggagcgcacgggagaaggccatcgacgagtggctcccgatcacctcgtcgcggaacgccaagtggtggtactccgccttccacaatgtcaccgccatggtgggcgccggcgtgctcagccttccctacgccttgtccgagctcggctggggccctggcatcgccgtgctggtggtgtcgtgggtgatcacgctgtacacgctgtggcagatggtggagatgcacgagatggtgcccgggaagcggttcgaccggtaccacgagctggggcagcacgcgttcggcgagaagctgggcctgtggatcgtggtgccgcagcagctggtcgtggaggtgggcgtgaacatcgtgtacatggtgaccggcggcaggtcgctgaagaagttccacgacgtgctggtgtgcggcgacggcggggcgtcgtgccaggggaaggacaacatcaagaccacctacttcatcatgatcttcgcctccgtccacttcgtcctctcccagctccccaacttcaactccatctccggcgtgtcgctggccgccgccgtcatgtcgctcagctactccaccatcgcgtggggcgcgtcggtggacaagggcaggatggcgggcgtggactaccacctgcgcgcgaccacgacccccggcaaggtgttcggcttcttcggcgcgctgggcgacgtggcgttcgcgtacgcggggcacaacgtggtgctggagatccaggccaccatcccgtcgactcccgagaagccgtccaagaagcccatgtggaagggcgtcgtcgtcgcctacgtcgtcgtcgcgctctgctacttccccgtcgcgctcatcggctactgggcgttcggcaacagcgtccaggacaacatcctcatcacgctcagcaggcccaggtggctcatcgcgctcgccaacatgatggtcgtcatccacgtcattggcagctaccagatctacgccatgccagtgtttgacatgatagagacggtgctggtgaagaagctgcgcttccctcccggtctgacactgcgtctcatctctcggaccgcctatgttgcgttcacaatgttcatcgccatcaccttccccttcttcggcggactgctcggcttcttcggcggattcgcctttgcaccgacgacctatttccttccctgcgtcatgtggctcgcgatctacaagcccaagaggttcagcctctcgtggttcaccaactggatctgcatcattctcggggtgatcctgatgattctgtcgccaatcggagggcttcggcagatcataatggacgcgaaaacgtaccagttctactcgtaaaatgctaccagacactgagttttttgtcgtgccaacaacagaggggaacttcctggtaccatgtataagctgttacagatgttgggttagctatatacatacatgcatacgtattgtttcttaattaatgttccaaggtgaccgtgggttgtgtatatggtataaaggagaatcgatgatggtggttgtccc

SEQ ID NO: 7987 - DNA, 612 bp, Arabidopsis thaliana
gataacaacaaattcgattcttataactgtttccctctcatctttacacaaaagtattctaatcgatttcaatggcgggtcgtggtaaaacactcggatctgggtctgcgaagaaggcaacaacaagaagcagcaaagccggtctccaattccctgtgggtcgtatcgctcgtttcttgaagaaaggcaaatacgccgaacgtgttggtgccggagctccggtttacttagccgccgttctcgaatacctcgccgctgaggtattggaattggctggaaacgcagcgagggataacaagaagacgaggattgttccaaggcatattcaattggcggtgaggaacgatgaagaattgagcaaattgcttggagatgtgactattgctaatggaggtgtgatgcctaacattcacaatcttcttcttcctaagaagaccggtgcttccaagccatctgctgaagacgattgattaatcaaccaaatccactctcttgtgttttttgagtttttaaggctttttaagagtaatttagattagatctatggtgaagaaagaatctatcttctgtgttttttgaattgaattgaatgttcatatgctttcaattaat

SEQ ID NO: 7988 - DNA, 2437 bp, Glycine max
ctgaaaatacagtacatttatttgatcttcttgatttgccttacaacaaggttgaggatttatacctcatttttcttgtaaataactcaataccactaagtctcccgtgttaaaatgaaagtccttcattcataggctccttttttttcaacagatgcttttattggtgtcaacattggttcagatatatctgacatgcccggtccaacagagattgttgctcttctgaaggctcaaagtatccaacatgtcagactctatgatgctgaccaagccttacttcttgcacttgccaacacaggaattcgtgtaactgtttctgttcccaatgaccagctacttggcattggtcagtccaatgccactgcagcaaactgggttactcgaaatgtcatagctcatgtccctgctaccaacatcactgccatatgtgttggatctgaggtcctaactaccctcccaaatgcagcccctattctagtctctgccataaatttcattcactctgctcttgttgctgctaatctagaccggcaaattaaagtctctagcccgcactcttcttctatcatccttgactctttcccaccttcccaagcatttttcaaccgtacatggaatccagtcatggttcccatgtttaaatttttgcaatcaacaggttcatgtcttatgctcaatgtgtatccatattatgattaccagcagtccaatggtgtaatcccactggattatgctttattccgccccctacctccaaataaggaagctgttgattccaacactctgctgcattatactaatgtttttgatgcagttgtggatgctgcttattttgcaatgtcagatttgaactttaccaatattcctattatggtgactgagtcaggatggccctccaaaggtgactcatctgaacctgatgcaactgttgataatgctaacacttacaacagtaacttgatcagacatgtccttaacaatacggggactcctaaacatcctggaattgcagttagtacatttatttatgagctttataatgaagacttaagatcaggtccagtctcagaaaagaactgggggctattttatgctaatggagaaccagtgtataccttacacttgactggtgctggtattttatttgcaaatgatacaacaaaccaaaccttttgtgtcacaaagagtaatgctgaccctaagatgttacaggcagcacttgattgggcttgtggaccagggaaggtggattgctcccctttgctgcaaggtcaaccatgttatgaacctgataatgtagttgcacattctacatatgctttcaatgcatattatcagaagatggataaatcacctgggagttgcgatttcaaaggagttgccactgtcactaccacagacccaagtatggcaatacatactcccacataaatatgagttggatacaaatatctgtgtacatttatttgtaaagccactagaacaccatagctataggcaataagaaaacatgcatgtttcaggcttgcaccttaacacaataggtttgatagaattgcaagtaagatgaattatgatgaaacttgtttcaggcttactacacctttagtccctctgtatcttcaattcaagagtttggtctattcaattttaaactcctttcagatgtggttcaatcttaccacagacattttatttggtgacaaagagagctcacatggcacataattagcttatgtggcaccttagccattcaacacaatctatgtgccacttcagcactttgcatctccaaatttatgttaagataggaccacaattgaaagaatttaagattaatgagaccaaaactgttgcgactaaaaacaggggactgcaattttaaaattgaagtaattagggaaaatgatcctgtgacgttaagtatgagaatagtggtattcaaatcttgcttatcagtttgtttcagaagtatatttgttaaaattatggatgattatattaatgtattttgaaatgttacatgaacactttttgaatttcatttccttagcatccttttgacataattaattagtcagtatgaaaaaatctcttcaaattttgcagcttttttctttcttgtccattttctattggctcagatttgttatacattaaaataggtcttgcataatgaattttctatttaaaattacttagcattataatacaataaatatcagttatattaaaatgctaagtaattttctatttaaaattacttagcattttaatataactgatatttattgtattataatttttacaggtcatggttcttgtatatttcctggaaggtatgatttctggagtctatgttagtttgcttgttgtcattcctttccgaatcatatgctagtcttgttctaagatgtcttattaatgtattttt

SEQ ID NO: 7989 - DNA, 1871 bp, Glycine max
gacatggtcctaaagtctggcctgagatgaatataaaatggactaatcttcttctggcttgttttcttcagaatcatgggggttacacagagttacaaattgctgcaaatggaataacttgttttcttcagtggcttctctctacctctcacctgaaatcaacttgtaatcttcatgagcttgcattgaattgatactttgataaagatggatgggaaaaaatctctacaaataactagaagtggtactggtgcttatgatgatgatggacatgccaaaaggactgggaatttgcagagtgctgtagctcatatcattactgctgttattggttctggtgttctctctcttgcatggagcacttctcagttaggatggattggagggccagttgcattgctttgttgtgcaattgttacctatatttcttcattcctcctgtctgattgctacagaactcctgatcctgtcactgggaaaagaaactactcttacatggatgctgttagagtttatcttggttataaaaggacatgtgtagctggcttccttcaatttttgactttgtatggtactagtattgcttatgtactaaccacagcaactagtctgagtgcaattctgagatcaaattgttatcacaagaaagggcatgaagctccttgtaaatatggtggcaatctgtatatggcactgtttggacttgttcagattgtaatgtcattcataccggatctccataacatggcatgggtttcagttgttgcagcacttatgtcctttacatactcattcattggactaggacttggcatagcaacggtcataaaaaatggaagaattatgggaagcttgacaggaataccaactgataaaattgctgacaaattttggttagtcttccaagcacttggtgacattgcctttgcctatccatactccattctccttcttgagatccaggacactctagagtctcctccaccagaaaatcaaaccatgaaaaaggcctccatggttgcaatcttcattacaacattcttctacctgtgctgtggatgctttggatatgcagcttttggaaatgatacaccaggaaacctcttgacagggtttggcttttttgagcctttctggctcattgaccttgctaatgcttgcatcattcttcacttggtgggaggatatcagatttacagtcaaccaatatacagtactgttgatagatgggcttcaagaaaattccccaacagtggctttgtgaataatttctacaaagtgaaactgcctttgcttccaggttttcagctaaatcttttcaggttctgttttagaacaacctatgtgatctcaaccactggtcttgcaatcttttttccttacttcaaccaaatcctaggagtgttaggagccataaacttctggccattggctatatacttcccagtagagatgtactttgtacagaacaaaattgcagcttggagtagcaaatggattgttcttagaacattcagctttgcttgctttcttgtcactggaatgggcttggttggctcacttgaaggaatagtaagtgccaaattaaagtagctgaaagatttatgccactccccttagtaatgcttactatatttgagtttgtagctagattgatggttgtataatgtttcatgtaaaaaagtttaaagttgatgctaagattgttgagagttagatagggagtaagcaattgtgggggatttctgaaagtgaataaagtggtactgtagtctttggaataatacaagttttgttttatgcagaactcacctcaaaggagagagttcaaacgaatttgtagtttgatattgatgttattgtgctgtatc

SEQ ID NO: 7990 - DNA, 1873 bp, Glycine max
atataaaaatagagggatctccttctcttatccagagaagcatatatagagaaagaaagaaggccctgccctatatagctgaaggcagtgtgcacaaactctgagactgcatattagagtttgagtcttcactctgaagcctaacttgggtttgtgtctctcatagcaagatgatggaaaacggtggcaaacagacatttgaagtctccaatgacacgcttcaacgagtaggttccaagagctttgatgatgatggccgtctcaaaagaactggaactatttggactgcaagtgcccacataataacagctgttattggttctggggtgctatctttggcttgggctattgctcagctaggttggattgctggtcctgtggtgatgattctattctctattgtgacttattatacctcaactcttctagctacttgttaccgttctggtgaccaactcagtggcaagagaaactacacttacacacaagctgttagatcctaccttggcggtttttcggtcaagttttgtgggtgggttcagtatgcgaacctttttggagtggcaattgggtacaccatagcagcttccataagcatgatggcaatcaaaaggtctaattgttatcatagtagcggggggaaaaatccatgcaaaatgaacagcaattggtacatgatttcatatggtgtttcggaaattatcttctcccaaattccagatttccatgagttgtggtggctctctattgtagctgctgtcatgtccttcacatactcattcattggacttggccttggtattggtaaagttataggaaacggaagaattaaaggaagcctaactggtgtaactattgggactgtgacagaatcccaaaaaatttggagaactttccaagcgcttggaaacatagcctttgcttactcctactcaatgatccttattgaaattcaggacacaatcaaatcccctccagcagagtcagagacaatgtccaaggctactttaataagtgttttggtcacaaccgttttctatatgctatgtggttgctttggctatgcttcttttggagatgcaagtccgggaaaccttctcactggctttggcttctataacccattttggctcattgacatagccaatgctggcattgttatccaccttgttggtgcataccaagtttactgccaacccctcttctcattcgtcgaatcaaatgcggcagaaaggttccctaatagtgattttatgagcagagagtttgaagtaccaatccctggttgcaaaccctacaagctcaacctcttcaggttggtttggaggacactttttgtgattttgtcaactgtgatagccatgctcctaccattcttcaatgacattgtagggcttattggagccattggattttggcccctcactgtgtatttaccagtggagatgtatataactcaaactaagataccaaagtggggcataaaatggataggcctacaaatgcttagtgttgcatgctttgtaattactatattagctgcagcaggttccattgctggggttattgatgatcttaaagtttacaagccatttgttaccagctactaattcaataggataattacttagtgatcatgatcaccattgtcagagatttcattagcaacaagaaaaaaaaaagaaggtaaattgttgcaaattgaaatcaacaggaaggtggtcttacttgtttattgcttagtaaccttgtatcttctgtatctttgtttttttttgtttgtgtgtgtgtgttctcttactttgtaacttgctctgtatccctaatttgcaatgagaaatggaggaaatgaagcagaggctttcaaattatc

SEQ ID NO: 7991 - DNA, 1878 bp, Glycine max
acgtaagctagctttggcatctttttcccctttttcctccaagcctataactatattcaacccaatctgcactggaccaagtgtaaaaagacattttcctgatcttctgctgtgccaagaaagcagtaatctccatgagcttctattgaattgatactttgatcaagatggatgggaaaaactctcttcaaataactagaagtggtattggtgcttatgatgatgatggacatgccaaaaggactgggaatttgcagagtgctgtagctcatatcattactgctgttattggttctggtgttctttctcttgcatggagcacttcccaattaggatggattggagggccattttccttgctttgttgtgcaattgtcacctatatttcttcattcctcctgtctgattgctacagaactcctgatcctgtcactgggaaaagaaactactcttacatggatgctgttagagtttatcttggttataaaaggacatgtgtagctggcttccttcaatttttgactttgtatgggactagtattgcttatgtactaaccacagcaaccagtctgagtgcaattctgagatcaaattgctatcacaagaaagggcatgaggctccttgcaaatatgggggcaatctgtatatggcactgtttggacttgttcagattgtaatgtcattcataccggatctccataacatggcatgggtttcagttgttgccgcacttatgtcctttacatactcattcattggactaggacttggcatagcaacagtcataaaaaatggaagaattatggggagcttgacaggaataccaactgataaaattgctgacaaattttggttggtcttccaagcacttggtgacattgcctttgcctatccatactccattctccttcttgagatccaggacactctagagtctcctccaccagaaaatcaaacaatgaaaaaggcttccatggttgcaatcttcattacaacattcttctacctgtgctgtggatgctttggatatgcagcttttggaaatgatacaccaggaaacctcttgacagggtttggattttttgagcctttctggctcattgaccttgctaatgcttgcatcattcttcacttggtgggaggatatcagatttacagtcaaccaatatacagtactgttgacagatgggcttcaagaaaattccccaacagtggctttgtgaataatttctacagagtgaaacttcctttgcttcctggttttcagctaaatcttttcaggttctgctttagaacaacctatgtgatctcaaccattggtcttgcaatctttttcccttacttcaaccaaatcctaggagtgttaggagccataaacttctggccattggctatatatttcccagtagagatgtactttgtacagcagaaaattgcagcttggagtagcaaatggattgttcttagaacattcagctttgcttgctttctggtcactgtaatgggcttggttggctcacttgaaggaatagtaagtgccaaattaaaatagctgaaagcctgaaaggttgtttatgccactccccttagtaatgcttactctatttgagtttgtagattgatggttatataatgtttcatataaaaaagtttaaagctgaatgctagtgttattgagagtaagatagagtacaagcaattgtgggggatttcagaaagtgaataaagtggtactgccagtgccattggaataatacaagttttgtttgatgaagaactcacctcaaaggagagaattctaacaaatttgtagtttgatattaatgtaattgtactgtatcatcaaatagattatatcaaattttaaattaatgatt

SEQ ID NO: 7992 - DNA, 2285 bp, Glycine max
ttaataatagaacacaagtagttaattcaataacaacgttttcaaaaattcacttctccttcaacgaggaaagcagcgtttcctgtttttgagttgtcgcattttgtgacggcttaaaggcatgggagacattgaagaacaaaccatctgacatagatctcatattaacagaagtggatttgccatcaatatctggattctcacttcttactttaatcatggagcatgacatttgcaaaaacattcccgtcataatgatgtcttctcatgattccgttagcatggtactcaaatgcatgttaaaaggtgcagctgattttcttataaaacctgttcgcaggaatgagctaagaaacttgtggcagcatgtatggagaaggcacgccataagcaggcctcctcaaaattttacactaccagagattgaaattggttttgctgcagaaaaccatgctgcaagcaatgactctagtggttctgtggcttctacagcaaaaaatggtgaatgcagcgagaaaacaagtgaggctcaagatatatcgcagctgaagaggtcttcaaatttgagcaatattgacacggtgaagcatgaaaattctaccaaatgtgaaagggaatcagataagcataatgatgaagctggagagaaatcactgtttgtatcagaagattcaaggtgcaacaaaacttttaaaccaacaggtttaaggctaggtcaaggctatgaatgctgtgaaacgagaaatcaagatgtagttctaaaaatagagttgatcaaatccaatcctgaaattaatacagatattcatggatgcagtgatgaactggtagatccttatactggggccattgacttgattgctacattcaagaatcttccaaagagcactgatgaaaaatgtagtttcagtagtggtaacactgccaagtttgattttgatacacaattggaactttctttaagaagaagagattttcctggaagctcatgtaaagctgcatctgaggaaaggcaattattgaaccattcaaatgcttctgccttttctaggtatagtagtagtaagttgttgcagcccctttttccaacaccatcaactatctctgctaaattaacaaattccagtctgagttctcatgaatcccataaattctcagaaaatgcatctacttctcatcaatatggtggaaaaaatcaaaatcaggagaaaattatcactccagtcattggtcagtctggacaagttgatccaaaattaccaaacagtcaacttggatattttcctgctacaggggttacttctgatcacaagtctacaggaaatggaaatgtcttcccttctatgctttatgcagaatcaggtgtccatcccatatggactccaaaatcagtgtgccagaaagaaagttctccatttcccacaatcacttcatcccagtccaatcctcaaagtcacaactcagaatgtcatctctggtcggaagattcaacccatgcttctgataaaaatttaaatgatcaaattaatttggattgtgagacacatgactctcctgatgctagtcagagtgctggtactagttttttccacgacacagcaaatcataatagtagcggtgtatacagaagcatgggctgcagaagtgatggaaatgctacttcagctaaggtagccaaggagagccatggaagttttattgatagtggtcactgcagttatgatggattcatagggacagattctcatcgcacaagccaccgagaagcagctctgacaaagtttcgactgaagcggaaagacagatgctatgagaaaaaggtgcgatatcaaagccggaagagattggcagagcagcgcccccgggtgaaagggcagtttgttcgccaagtacaagatgatcatccagtagcagatgtgggtggtggttcctgaaattgttttgtttcaagttaccttcatcattgaattacagtctgacttccaaatctgatttgcctttctcgacaaggattaactgtagggtctagtttgtctggtgaaattatgtttcctcttagcgttgttagtattttcttctggcttgttatattggctgtttcttagaatgtaggattgtaagtattttgtaggtttgttttgaagttttgattttacctcgtgtatatgctttcttgattgaatactaatatagggctactatcgttatataggcagtatgcttgtgtcttgaaagattgaatttttatttttttttatctcggcaagcatctctggtttgcaagc

SEQ ID NO: 7993 - DNA, 2217 bp, Glycine max
cttctttatacggatggcagcaccattggcatgtcttgttgggagtggtttatctatacagagtaataaattaactcttggcaaggacgtcaatggaagatatctcttctcatatcataggctttcagcacagagtaaggagtcaaagacaatatgcataaaggcatccttggatcaaaggaagcatgaagggagaagaggatttctgaaattgttgaatgtgggagttggcttacctgtattattaggaggtgggaaagcgtatgctgatgaacaaggaccttcctcctccagaatgtcttattccagatttcttgagtatttggataagggtagagttaaaaaagtggatctgtttgagaatggaacctcggctgttgtggaggctgtttctcctgagttgggtaatagggtgcagcgagtgcgtgttcaatttcctggacttagccaagagctccttcagaaattcagggaaaagaacattgactttgccgctcataatggccaagaagagacaggttctccattagctaacctgattgggaacctggcttttcctctgattttgattggaggattgttccttctctcgagacgatcatcaggagggatgggaggtcccggtgggggctttcctcttgcttttggtcaatctaaagccaagtttcaaatggagcccaatactggagtgacatttgatgatgttgctggagtggatgaagccaagcaggattttatggaggtggtggaatttcttaagaagcctgagaggttcactgctgttggggctcgcataccaaaaggtgttcttcttgttggtcctcctggaactgggaagacacttttagcaaaggctattgcaggtgaagcaggtgtcccatttttctcaatctcaggttctgagtttgtagagatgtttgttggtgttggtgcttctcgagtccgcgatttattcaggaaggccaaagagaatgccccatgcattgtttttgttgatgaaattgatgctgttggaaggcaaagaggtactggaattggtggagggaatgatgaaagagaacagaccctcaatcaacttttgacagaaatggatggatttgagggtaataccggtatcattgtcattgcagctactaacagggttgacattcttgattctgcattgttaaggccgggacgatttgataggcaggtcacggttgatgttccagatatacgaggaaggactgaaattttaaaggttcatggtagcaataaaaagtttgaagctgatgtttcacttgaggtaattgctatgagaacacctggttttagtggagcagatctggcaaacctgctgaacgaagctgctatattagctggtcgtcgtggaaagacagcaatttcttccaaagagattgatgattccattgataggattgtggctggaatggaaggaaccgtaatgacagatggaaagagcaaaagcttagtggcatatcatgaagttgggcatgctatttgcggaactttgactcctggtcatgatcctgtacaaaaagtaaccttagttcctcgtgggcaagctcggggtcttacttggttcattcctgctgatgacccaactcttatctctaaacaacaactctttgcaagaattgttggtggacttgggggcagagcagcagaggaagttatttttggtgagcctgaggttacaactggagcagctggtgatttgcagcaaataaccagtttggccaagcagatggtaaccacatttggaatgtctgatattggtccttggtcactcatggactcatcagctcaaagtgatgttatcatgagaatgatggcaagaaactcaatgtcagaaaagcttgctgaagacattgatgctgctgtcaagagactctcagatgaagcatatgaaatagcattgagccaaataaggagcaaccgtgaggcaattgacaaaattgtggaagttctattggagaaggagacaatgtctggagatgaattccgagctctcctgtccgagtttgttgaaattcctgctgaaaatcgggtccctccttcaactccctcaccagttgttgtttgaatagcctatatgccactgcaatgtagtgtagctctccacatactgaatttttctaaaattgtaaaatatttgtaatatacccttgactcttaattttagtaatgacaaaagatcctagcttgcttcttttt

SEQ ID NO: 7994 - DNA, 2618 bp, Glycine max
aatggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcaggcaagtggttgataaataaatcttagtaacctgcatcatgcatacaaattccagcatggtaactttctaaataatgtatgatgatttgatcctccttgattagtttttcttatttcggtgttcatttttattcaatttgtttcttaactggaataaagggcgaagagcaaaagaaactggatgtcctttccaatgatgtctttatcaaggctttggtcagcagtggacgaacagtaagtcatcaatatgtgatttggtgtgtcttgaaaactaagggttttttttttttttttgtaagcgtctaattgaaaactaaaggtatataatatataatatatagtatgtgcttttgttgatgatggtgagatatatttttccagtgcatcttggtgtctgaagaagatgaggaagcaacatttgtggaagcttctaagcgtggaaagttgttacctatctatagcttagtagtatttcttccatagggtccgtttgctagagtcgaatggcatagaatgaaagtgaattgagatgaaagttttgaattaaaatagaataaaagaatatgttttacctcattttactgttcattttactcattttctgtcctcttttcctgcaaacgaacatgcccttggtgtttatttaaccttggttttgccaagtctaatcaatttgtacgaaattttctgattgtgcagatactgtgttgtttttgacccgctggatggttcttctaacattgattgtggtgtttcaattggcacagtatggtccctcctcctccatatatccttcttgaaatgcatattccatgtgtttttctctttccattgaattctcccgcaatattagtataccagacacagagaagggattaattgataatattgcagattgaatataatatattgcggttgtcaatttgagtgtgttgtcttccatttagatctttgggatttatttgataaaagaagaccatgaaccaaccattgaagatgttttgcaacccgggaagaacatgttggcagctggttattgtatgtatggaagctcttgcacgcttgtgttaagcactggaagtggtgttaatggtttcacccttgatccatctcttggggaattcattctaactcaccctgacatcaagattccaaagaaaggcaagatctattcagtgaatgaaggaaatgctaaaaactgggatgaccctactaccaagtatgtggagaactgcaagtatccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggcaaccaaagggtaatttaccaaaaacagggcgaaaaacaaaaaattagtttagactaaatttctctcaacccttgtttgagatgaaaaaatgaataggaaattttgaaattcaaattaaagagaaaatagaaagtaagaaagaaaatatttttttaaaaataaatttatttattaatttttaatcaaacaaaaaaatatcacttatcatatttttttcgtcctttttattttattttctttcattcaaacgtagtcaataaatattgattcaattaataaaaatcatatttatctctcataagaacatgtgtttaagttttactcttaaatgtgaggactttattcatacttttattgatatataatataagtatttttatatgttatgagaaaatcttagagacatacattgacactaatgaatccttgagacccaattgaactaaattttttctcaccaaaacacatcacttcctttagacaagcaagagagagacatagacgaccagagtctttcaaagacactacctttaacataattggcaaaccccttcattatcaatgatactttgagcaccagaaaatttgtgtttctttttctcctctattaacattaagaaaaataagagaatccataatgattttaattagaatattataaatgcatcatatgccagtgaaagtgatgaatctagctatgtcaacaggcacttgatttggttccaaagaagttgcacgagcgatctcccatattccttggtagctatgaggatgtcgaggaaatcaaggctctttacgctgctgaggaatgaagctggaagaaagcattctttgtctttcgctacttacaagcaattgttatctaattgttacacacatacatggtcatgtatatgttaagaaaacttgttaatgttttgtgctttagaaaaattatttcattagttatatctaaatattttaaattttaat

SEQ ID NO: 7995 - DNA, 1758 bp, Glycine max
aaaccatggaagtctttctgatcgtataatgagctactatggagactcgcctaggggaatggtagaatctgcttttgaatttgcaaggatatgccgaaagttagactatcacaattttgttttttctatgaaagcaagcaacccagttatcatggttcaggcataccgcttacttgtggctgaaatgtatgtccaaggctgggattatccattacacttgggtgttactgaagctggagaaggtgaggatgggaggatgaagtctgcaataggcattggaactcttcttcaggatggattgggtgatacaattagggtttctctcacagaaccaccagaggaggagatagacccttgcagaaggttggcaaatcttggaatgatagcttctgaactccagaagggggtggaaccttttgaagaaaagcacagacattattttgactttcagcgccgatctggtcaattgccagtgcaaaaagagggtgaggaggtggattacagaggtgtactgcaccgtgatggttctgttctcatgtcagtctccttggatcaattaaagatgccagaggtcctctacaagtcacttgctgccaaactcattgttggcatgccatttaaggatctggcaactgtagattcaattttattacgggaagttcctcctgtagatgatgctgatgctcgactagcactcaagagactgatagatattagcatgggggttataactcctttgtcagaacagctaacaaagccattacccaatgccatggttctagtaaaccttaaggaaatatcttccagagcttataagcttttgccacaaggcacacgcttggttgtgtctgtacgaggtgatgagccttatgaagaactggacattcttaaaggcattgatgctactatgcttctccatgaccttccttatacagaagacaaaattagcagagtgcatgcggccaggcggttatttgagtacctatccgacaattctctaaacttccctgttattcaccatattcagttcccaaatgggattcacagagatgacttggtaattggtgctggttctgatgctggagcccttctggtggatgggcttggagatggacttcttttggaagcgccagacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccccggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagaacatggacgatgggtggaccctcctgccgaggagtaaaagcaagagcttaattttgagattggcattcaaggccatagtaagatgagcattgtcatatccaattattgtacacatgtaatataagataacactcaatgcttaagtttgagcctagttttaagttccttttgagaaagatcccaattaaagcttgttgtgaggaaatcgacagctagaacatgtatacagataacagtgtattgctttgccccatcagccatcaataataatgagaatctctt

SEQ ID NO: 7996 - DNA, 612 bp, Glycine max
gagcaattttgtcaccgcagaatatgatatacccattccctgctttggtgtgtaccaactcaacttcttccgcttagtatggaggaccatttttgtgctgttgacgaccctcatagccatgctcatgccttttttcaacgatgtggttggaatacttggcgcttttgggttctggcccttgacagtttatttccctattgacatgtatatttcgcaaaagaagattggacgatggaccagtcgctggcttggacttcagttacttagtgccagttgcctcatcatttcattgttagctgcagttggttccatggcaggggtggttttggacctcaagacttacaagccatttaaaactagttattaaatcaaggccgtaagaaatagctagaagtgtttgaacatatgatatttttatacaaaactaatgataagttagtttgtgaaattaaagtatatacgttccatgcctgctgctgttagagcaacttgatttgaggaaaaaagtgataattggacataatatacctcagatttggacgtatacagtctgtgtatgtgtgttattttacaaggaataaaagtctttgaacgtgttatttctttagtcat

SEQ ID NO: 7997 - DNA, 1959 bp, Glycine max
gaatctccttcctcttcgcatcatgttctggcctgtattttttataatgaaatctagtacaataaagttttcctgattttatgctgtgtcctgtcgttagtaatgtctgttttagtacacaccttaattatcaagaacatggcttccaaaagttttaagaaactagctattttaattttggtttggcacagacacacatgcttatcagcatagtttagatttatttacactatttcctgcaacttcttctatgctgctagtcaattacttaactttaggagagttgtcgtagacatcttcctttttaatttaataagcatgttacatgcaaaccaaaattatgtagttaccaaacaaacataattttgaattcaagtaggtgccatatagttcctttgattgtagttggctgtagactgtacagggaattcaattgcactgaactccatgaataccaattgagttggatgcttggataaaaatggctgttcaaaactctctccaaataactagaagtggtagtggtggttatgacgatgacgggcgtgctaaaaggactggaactttatggagtgctgtggctcatatcatcacagccattatcggtgctggtgttctgtctttagcttggagtacttcccaattgggatggattgcaggaccagtttgcttgcttttttgtgcaattgtcacctatgtttcttcattcctcctttccgattgttacagaactctggatcctgtaactgtgaaaagaaactactcttacatggatgctgttagagtctatcttggcaataagaggacatggttggctggttcccttcaatatttgagcttgtatggggttagtactgcttatgtaattaccacagcaacctgtttgagagccatattgaaatcaaattgttatcacaaggaagggcatcaggctccttgtaaatatggggatgtagtatatatgatgctgtttggactagttcaggtcataatgtcattcataccagatctccacaacatggcatgggtttcaattgttgcggccataatgtcctttacatactcatctattggacttggacttggaatcacaacagtcatagaaaatggaagaattatgggtagtttaacaggagtaccggcttcaaatattgctgacaagttatggttagtcttccaagcaattggtgatattgcctttgcctatccatacacagtcatcctccttgagatacaggacactctagagtctcctccaccagaaaacaagaccatgaaaaaggcctccatgattgctatcctcattacaacattcttctacctctgttgcggatgctttggatatgcagcttttggaaatcaaacaccagggaacctcttgacagggtttggattttacgagccttactggctcatcgactttgcgaatgcttgcattgttcttcacttggtaggaggatatcagatttacagtcagccgatctatggagctgttgacagatggtgttcaaaaagataccccaacagtggatttgtgaataatttctaccaattgaaactgcctcggttgccagcttttcagctaaacatgttcaggatatgttttagaacaacctatgtggtttccacgactggactcgctatcctatttccttacttcaatcaagttataggagtgttaggagccttaggcttttggccattggctatatatttctctgtagagatgtactttgtgcagaggaaaattgaagcttggtctagaaaatggattgtccttaggaccttcagctttatttgctttctggtgtcattagtggccctcattggatcacttgaaggaatcataagtgagaaactaagctaatgaagggtgcttcatttgtttgagtttattgtcttgttgccatatcttccatgtaattcagtttcgcattaattctattactatttactatt

SEQ ID NO: 7998 - DNA, 1127 bp, Glycine max
ctatcatgtccttcacttattcttcagttggattgagtcttggagtggccaaagtagcagaaaataaaactttcaaaggaagcctgatgggaattagcattggcacagtaacacaagccggaacagtcaccagcacacagaaaatatggaggagtttacaagctcttggggcaatggcctttgcatactccttttccattatcctcatcgaaattcaggacaccataaaatttcctcctgcagagcacaagaccatgagaaaggccacaacattgagcatcgcggttaccacagtgttctatttactctgtggatgcatgggttatgcagccttcggagataatgcacctggaaatctcttgactggttttgggttctataacccttattggcttctggacattgccaaccttgcaattgttatccacctagttggggcatatcaggttttttcccagcccttatttgcatttgtggaaaaatggagtgtacgcaaatggccaaagagcaattttgtcacggcagaatatgatataccgattccctgctttggtgtgtaccaactcaacttcttccgcttagtatggagaaccatttttgtgctgttgacgaccctcatagccatgctcatgccttttttcaacgatgtggttggaatacttggcgcttttgggttctggcccttaacagtttatttccctatcgacatgtatatttcgcaaaagaagattggacgatggactagtcggtggattggacttcaattacttagtgtcagttgcctcatcatttcattgttagctgcagttggttccatggcaggggttgttttggacctcaagacttataagccatttaaaactagttattaagtgagatttaaagaaggtcgtagaaatagaagtgtttaagcttgatgatattatagaaaactaatgataagttggtttgtgaaatttaagtatatacgctccatgccgctgctgttagagcaattgatttgagaagaagaaaaaaatgataattggacataacatacctcagaatttggacgtatacgtgtctgtgtaactgctatattgaagtcaattgtaaggaataaaagtctttgaacgtgttatttcttt

SEQ ID NO: 7999 - DNA, 951 bp, Oryza sativa
gctccaaatcgccacgcaggaagggaggaaaggaccaccagccaccgcgcgcgcccaaatcgtcgcagctgcttccccgaggagaagaacatgagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgacgacaccccttatgagcttgatcttgagctctttgatgctgtgaatgttgaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggcttggtgacttcggtgatatggacttctcgaagctgggcatgggaggtcctgatgatgatcttgaggacgatgacgaagatgacacggctgacagtgctaacaaagatgatgaagacattaaggcagaggggagcggggaacaggaagctgctggtgaagcgaagccgtgaaatacctgagagttttagaacgctatgcttgacttgtttgtgacgctgccaggtcttaagatttttttggtgtaaactctggagagtggatcactgccactaaagtaaagtagtagttatggtttagtagctccattttgttaaaaaactttgtgcattgcacactgttctgttatgtgaatcgccatatttgcatcaaccattgcaaagctatccagccattctgtgtttcatacttttactcatagcggtttggtggcatgttccatttgccttgtactttggaacttgcataattgttcgtgactgtaaaaataaactgaagtatccagcttgctc

SEQ ID NO: 8000 - DNA, 1583 bp, Oryza sativa
catgcgagcaagcaagagcggttttagccatcaaagccgaaagccatccgggcattcgctctcccctcgctgctagctagctttgcttgctaatctagagctaagcaccaaatggtcctgattgttcttctcgcttctgaattgttgtgacctgtaactacaaaggcatagttaggtagatatagaaagagggggggagaggggccggaggccggagcggcgggggcggcggcgagatgaagctccacttcgtgctcaggttcctgttcggccccgtgccggtgtacttctcggcgctggccatcctcatcctgctgacgaacgcgcagtacttcgggctggtgggcgtcaccgttccccgcgcgacgaagctggcgtcgtcggcgccggtggtgagcgtgatgaagtactgcgacatcttccgcggcgagtgggtgccggactccgacgcgccctactacaaccacaagacgtgttacatgatccaggagcaccagaactgcctcaagtacggccgccccgacctcgaattcctcaagtggcggtggcgcccctccggctgcgagctgccccgcttcgaccccgtgcagttcctacagttcaaccgtcacaagtcgctcgccttcgtcggtgactcgctggctcgcaaccacatgcaatccctgctctgcctcctctcccaggtggcgtatcccaaagacatgtcggcgaacccgacgactcagaacaaggtgtaccactacagggggtacaacttcaccgtcagcatgttctggtcgccgttcctggtgaaggcgcgtgagcccgaccacgacgggccggcgcacacgggccactggagcctgtacctcgacgagcccgaccagtcgtgggtgtccgagatctcgcggttcgactacgtgctggtgtccgccgccaactggttctccaggccgtcgctcttctacgagaagcggcggctggtcgggtgcagcttctgcagcaggcagtacggcgtgccggacctgacgctctactactcgcagcgccgggcgtggcgcgtggcgctgaaggcgatcaacgacctggagagcctccgcgggcgggtgatcgtgcggatgctgtcgccgatgtcgcacttcgagaacgggacgtgggaccagggcggcaactgcaagcggacgcagccgctccggagcaacgagacggtgatggaggggcgggacctgcacttctacacggcgcagatggaggagtaccgcgccgcggagaaggtcgcggaggccaagggccggcggatgatgctcatggacgccacggcggcgatgctgatgcggcccgacggccaccccagccggtacggccacctgccgaaccagaaggtgcagctctacaacgactgcatccactggtgcctgccaggccccatcgacatctggaacgacatgctcttccagatgctcctcgtctaacgcgatcgatcgccaattcgccatcggtaaatgcgacttctactgcacagacaggattgctcttgctgttgtttcaaagcagttttgacaaggatttattcgaacttccccaatagattctttttttctctc

SEQ ID NO: 8001 - DNA, 2335 bp, Oryza sativa
ctcctcctcctgtgttcgtgttcttcttcttcttgtagcagcgcttaaccaacccatcattagcgaccaaacctctctccctctccccctctgactaatcaaaattaaacaatttcgatctccaccttcctcttcttgattccagttccaccagagagagacagggtcttctctaatccatgtggtgcttgttggtctcgcttgcttcgtcttcgtcttcgtcttcctcttctcgcacctagtcccgcctcgtcgcctcctccggagaccggagccggacgggacggttgccggcgagcggcggtcgctttcttctctcggccctactcacgttattttcagtgactcttcttccaaaccaagtggtaaagccaggattctaccattacaatgacgatctgcagctgtgaggagacgatcaatgagtttgagatgttaacgcgtgatgctgcgcgtgtgcagaaggatacactgaaaaagatccttgagataaatgctagtgctgagtacctgcagaactttgggcttggggggaggactgatgccgagagctacaaatcctgcatcccattgtgtgtgcacaatgatattgagccctatatccagcggattgttgatggcgatacctcaccagtggtcactggagaacccatcaccaacctctctctcagttccggtacaacacacggaaagcccaagttcattccattcaatgatgaattacttgagaccacacttcaaatataccgtacatcttacgcgtttaggaaccgtgaataccctattggccaaggaaaagcactgcagtttgtttatggtagcaagcaagtcataacgaaaggtggcattcttgcaacaactgcgacaacaaacttgtataggagacagcgctataaggaaggcatgaaggatatccagtcgcagtgttgcagtcctgatgaagttatctttggccctgatttccaccaatccttgtactgtcacttgctgtgtgggttaatatactcagaggaggtccattcagtgttctcaacatttgctcacagcctagtccatgcattccaaacattcgaggaggtttgggaagatctatgcactgatataagagacggtgttctctcaaagaaagttacagcaccatcaattcgtgaggctgtttcaaaaatcctgaagcccaatcctgaacttgctgactcaatatacaagaagtgtattggtttgagcaattggtatggagtgatcccagcactgtggccaaatgcaaagtatgtgtatggtatcatgacaggatccatggagccatatctgaaaaaattaaggcattacgcagggaacttgccacttataagtgctgactatggcgcatcggaaggatgggttggctctaacatagaccctactgtgccaccagagcaggtgacatatgctgttctcccacaagttggttattttgagttcattcctttggagaaaccaataggggaggagacagaaaactccgcctccattcattacatagaatcagatccagttggcttgactgaagttgaggtcggcaaaatctatgaagttgtaataactaactttgcaggtctatatcggtacaggctaggagatgtcgtgaagatagcacgcttccacaactccacacctgagctccaattcatctgtcgcagaagcctagtgctgagcatcaacatcgacaagaacaccgagaaagacctccagttggctgttgaggaggcatcaaagttcctggaaggagagaagctcgaagtcatggatttcacgagcttcgtggaacgatcaagcgatccagggcgctacgtgatcttctgggagctgagtggcgatgcgagtgatgaggtcttgagcagctgcgcaaatgccttggatctagccttcattgacgcaggctacacgggctcgaggaagatcaagacgatcggcccccttgagctccggatcctcagaaagggaaccttcaaggagatcctagatcatttcctaagccttggtggtgcggtgagccagttcaagacaccaaggtttgtgaacccatcaaacagcaaggtgttgcagatactgagtagaaatgtcacccaaagttatttcagtactgcctatggattttgatacaaagaaacatattagatgctagcagctgcatgtaattacctttttacctcttgtttttcagctttactgtagtctccaccggaagaaaacgtttggtttagtctcttgaataatctattttcttatcctgtttgtgactatctagaatctatgtaaatggcccagctctagtgaaagttatggtgatgttatcagg

SEQ ID NO: 8002 - DNA, 2149 bp, Oryza sativa
tcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattcatacttataacgtctttttttatcaaattatgttggctgaatcccttggagtgtgccaatttccatcttg

SEQ ID NO: 8003 - DNA, 1514 bp, Oryza sativa
gtcgctcgcctccgctgctggtgtcgagccgcttccgatccccccccctcccgacgcgaggccgaaaccctaccgccgatgacgtcatccggcgctcccccgccggcggcgatggccgtggacgacgcggaggacgaccagctcgcctccatgtccacggaggacatcgtccgtgcctcccgcctactcgacaacgagatccgcgtcctcaaggatgagctgcagcggaccaacttggagctggaatcgttcaaggagaagattaaggagaaccaggagaagattaagctcaacaagcagcttccctacctcgtcggcaacatcgttgagattctggaaatgaaccctgaggatgaagctgaggaggatggtgctaatattgatttagactcacaaaggaaaggaaaatgtgttgttctgaagacttccacaagacaaactatattccttcctgtggttgggctagttgaccctgataaactcaagcctggtgatttggttggagtaaacaaagacagctaccttatactggacacactgccatcagagtatgattcacgagtaaaggcaatggaggtggatgaaaaacccacagaggactacaatgatattggaggtcttgaaaagcagattcaagagcttgtggaggcaattgttttgccaatgacacacaaagatcggttccaaaagttgggcattcgcccccccaaaggagttcttttgtatggaccacctggaactgggaagacattgatggctcgtgcatgtgctgcacagacaaatgcgacgttcctgaaattagctggtccacaattagtccagatgtttatcggtgatggagcaaagctggttcgggatgcttttcagcttgctaaggagaaagctccctgcatcattttcattgatgagattgatgccattgggactaagaggtttgacagtgaggttagtggtgacagagaagttcagaggactatgttggaattgctgaaccaactcgatggatttagtagtgacgagcggataaaggtcatagcggcaacgaatcgtgctgacattcttgatcctgctttgatgcgatctggtcgtttggaccgaaagattgagtttcctcatccatctgaagaagcaagagctagaatcttgcaaattcactcaagaaaaatgaatgtaaacccagatgtgaattttgaagagctggctcgctcaacagatgacttcaatggagcgcaactgaaagctgtttgtgtcgaagctggtatgcttgcactgcggcgagatgctacagaggtgactcatgaggacttcaacgaaggcataatacaggtgcaggctaagaagaagtctagcctaaattattacgcttaacaagctatgctagaatcatcagggctctggagttgtttgtaaccatactgtttggataatcgaaaatatggcttcacgtttcatttgaggtataacttttttacactataaagtcatcacttgcttcttatgtgatggaaagttgg

SEQ ID NO: 8004 - DNA, 2172 bp, Oryza sativa
gaagaattggggtagccccatgccacctggttcgggctagatctccggcgagacggccgctgggagcagccgatccggccccgatccgatgggtggcgaggtgccggagccgcggcggctcaaccgggcgctcagcttcgacgactgggtccccgacgaggcgctgcacctcgtgatgggccacgtcgaggacccgcgggacagggaggcggcgtcgcgggtgtgccgccgctggcaccgcatcgacgcgctcacgcgcaagcacgtcaccgtcgccttctgctacgccgcgcgccccgcgcgcctccgggagcggttcccgcggctcgagtcgctctcgctcaagggcaagccccgcgccgccatgtacgggctcatccccgacgactggggcgcctacgccgcgccatggatcgacgagctcgccgcgccgctcgagtgcctcaaggcgctccacctccgccgcatgaccgtcaccgacgccgacatcgccgcccttgtccgcgcccgcggacacatgctgcaggagctcaagctcgacaagtgcatcggcttctccactgacgccctccgcctcgtcgcccgctcgtgcagatccctgagaactttatttctggaagagtgccatattactgataagggtggtgaatggcttcatgaacttgctgtcaacaattctgttctggtgacactgaacttctacatgactgaactcaaagtggcgccagctgatctagagcttcttgcaaagaattgcaagtcattgatttcattgaagatgagtgagtgtgatctttcagatctgattagtttttttcaaacagccaatgcgctgcaagactttgctggaggagcattctacgaggtaggagagctcaccaagtatgaaaaagttaagttcccacccagattatgcttcttggggcttacctacatgggaacaaatgagatgcctgttatcttccctttttcgatgaaactcaagaaactggacttgcaatacacttttctcacaacagaagatcattgtcagattattgcaaaatgtcccaatctactaattcttgaggtgaggaacgtgataggagatagagggctagaagttgttggtgatacatgcaagaagctacgaagactccgaattgagcggggtgatgatgatccaggtctgcaggaagagcaaggaggagtttctcagctaggcttgacagccgttgctgttggttgccgtgaattggagtacatagctgcctatgtatcggatatcaccaatggggccctggagtctattgggactttctgcaaaaatctatacgactttcggcttgtgctacttgacagagaaagacaggtaacagatctgccacttgacaatggtgtctgtgctctgttaagaaattgcacaaagcttcggaggtttgctctctaccttagaccaggagggctttcagatgatggccttagctacatcggacagtacagtggaaatatccaatacatgctactgggcaatgttggtgaatctgaccatggattgatccgtttcgcagtgggctgcaccaaccttcagaagcttgaattgagaagctgctgcttcagcgagcgagctttgtccctcgctgtactgcagatgccctccctgagatacatatgggtgcaaggatacagagcatctcaaacaggccttgacctcctgctcatggccaggcctttctggaacatcgagtttacacctccgagccctgagagttttaatcatatgacagaagatggagaaccctgtgtggatagccatgctcaggttcttgcctactattcccttgctggaaggaggtctgactgccctcagtgggtgatccccttgcatcctgcgtgattgtaaatatgtcaagctgtgtataccttcctatctatccctggggcataagcatggccttgtatggttattgtaagaaccttagcttgccacctttgtgattgtgcccgaataagctactactagtactttagctggggtctatagtgcaataagttgttgtcacttgttctacgtatctaatcctaggaagatgtatactaagttcctctgtaactgtaagagtgatctgtgctttggttgcgagatgtacattgtaagtatcagaaatcatgtgttactggtttttttgccat

SEQ ID NO: 8005 - DNA, 876 bp, Oryza sativa
cttcgtcttctcctctcttgcagcatagtttaagtttgagataggattggcgatagatatgaggccgactggtcgtcgttcttctccgccggtggctgctgctcttgccctgcttctcctcctcgtcctcttcttcttctcccactgcgcctcagctgctcgcccactgccagcatcagcagcagcagagctagtgcttcaggatggcgccaccggcaatggcgacgaggtttccgagttgatgggagcagctgaggaggaagcagcaggattatgcgaggaggggaacgaggagtgcgtggagaggaggatgcttcgcgacgcccacctcgactacatctacacgcagaagaggaacaggccttgaaatcttgaatcataatctccaagtcgatacaaggaggaattaatcagtagtaaacctacataaattaatctactatctgcagcctgttttcaactgcatgtatcagtgtattagtcgatctaggataatattttgcatgtgtactcaagtaaactgtcgtctgtataaccccgttatgtacatggttgtatttctttctccaaagtgttatcgaactctctgttgatctctgatacatctgtatgtgtagcatcagagaaaagatcgagcacttgtgggttatgatctgacgatcgagtgtatgaacagtgctaatggtgtagtaagtttttgcttaattgtcttggacttctcatggtgtgaaatgttcgaacaagcagaacatattccctatatcttccttggtagctggtgcttggtactactaccagcacaaatgttaccagtatgcatgtttcataaagagaaggtataatggattataaatatataaacttgcatttgttttc

SEQ ID NO: 8006 - DNA, 1124 bp, Oryza sativa
gttgaactccacctgagcacaggagaagccgcagccactgagaaaaacacaaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctcc

SEQ ID NO: 8007 - DNA, 1242 bp, Oryza sativa
gcgacttcccatctaacatattgcttccggcagccgccgccggacaccatggctgactctccgagcccacgcctggacgaggaggacgccttcggccgcgacttcaactcgtccccttcgcccacagccccacccgcccgctccggcgagaagaggccgttcggcgatctggacgacgatgacgaggacgttttcgcttccaagaagggaaagacaaaggtggaagaaagtgcgccaggtgctgccacgggaatgattctgtctcttcgcgagagtttgcagaactgtaaagataatcttgcgtcatgtcaggtggaacgggaggctgccaaatcagaagttcaaaagtggcattcagcatttcagaacattccagctgtacctgctggaaccaatccagatcctgtttcggttgtttcttatctcaataacctgaagtcgtcggaagaatcattgaaggagcagctggagaaagctaagaaaagagaggcggctttcattgtaacatttgcgaaacgtgaacaagaaattgcagaactgaagtctgcagttagggatttgaaaactcaattaaggccaccatcgatgcagacaaggagattattgcttgatccagcaatccacgaggaatttacacgattaaagaatcttgtggaggagaaggagaaaaagatcaaggaactacaggacaatgttgctgctgtcaattttactccatccagtaaacatgggaaaatgctaatggccaagtgtagaacattgcaagaggaaaatgaagagattggggcgatggcttctgaaggaaaaatccatgaacttggaatgaaaattgcagttttgaagactcggaacaatgaactcaggaatcagttcaatgagctgtataaacacatggatggtctaacaaatgacgttgaaagatcaaatgaaatggtggtcattcttcaagatgagttagaaacaaaagatgtagagctgagaagattgaaggagatgcttgcccagaaagaagcaactgatgagaacaaaatacctcaagaaaatgacgtcgctggagatgatatagttgctgccgccgagagtcagccaataaaagtagaaacataagctacgccttcagcagtcatttctagagtagcttgcgttctcaacattcttattattttttgtatcatgtatcagaagtgtttacttgtgtaatttatctaatgtcgtttattcttgccgatttgcattgcgctt

SEQ ID NO: 8008 - DNA, 1526 bp, Zea mays
gtgccgcgccttcctcttcctggtaccctgtgattggagccagtattgttagcgtttaatgaagctgcttttttctagccggcttttggatggtgcttactactacatcgtatcagttgccaccactctcgcgtgcttttgccttctttaggtttgctcgcagggcacacaaagccatttttactgctggaagactgccgcttttagtatctctgggctctggctcttgagtgatctccaagggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcagagcaagcccgagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggagcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggcggtggcttcggcgagagcttcgccggcttcgactggccgccgtcgccgtgacgtggcccgcgagagccgctgctgcgcttgcgttgcgcggaccgtttgcggctcttgcttatataccgcgtgcgtgcctgagtcgttgtttgttgttcgtcccaagctttgtttgcagatgtgtgctttcaatctttaagctctagcttgcagatatgtgaagtggactgctagtagtagtacactctagctgtaaaactccggtgtttacctgaagcaaaccagcatgcactggtgagatttcaccggcgccatcccc

SEQ ID NO: 8009 - DNA, 1443 bp, Zea mays
caaaagcaaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagctgctgggcccggagctgcaggagatgcgcggcggcctgatccgcctctgcgccgacgcggaggcgctgctggaggcgcactactccgacctgctggcctccttcgacaacccgctggagcacctgtcgctcttcccctacatcaacaactacatcctgctgagccagctggagcacggcctgctggcgcggcacgtgccgggcccagcgccggcgcgcgtggccttcgtcggctccggcccgctcccgctgagctccctggtgctcgcggcgcgccaccttccgggcgcctccttcgacaactacgacatctgcggggaggccaacgaccgggcgcggcggctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccggggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacggcgccgtgctcaaccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatatatctcatctaatatccatccatccatctatagcagtattatgtatgcatccacatggtaataatctggctgaccgcatccgcatatggtcgtctcatcgtccatctataccttgaaagctactaattaattactgagttattattaatactgtttttactactactacgtactattaatattactacaactacctcatctagctggtgtattaattgattttgtctgttactactgt

SEQ ID NO: 8010 - DNA, 1750 bp, Zea mays
ccctgctgctccgcgccacacctctccgcttcattcctatccgtctcccctgctctatcgtcgtcctcctccgtcgggccggaggagcgtctctttgtcggcgcagcgtgcagagcaccgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcagaatagagctggctaaatgcatagcgaacccatcctgtgcagcaaacgtagcatgcttgaacacgtgcaacaatcgacctgatgaaactgaatgtcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagact

SEQ ID NO: 8011 - DNA, 1356 bp, Zea mays
ctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacg

SEQ ID NO: 8012 - DNA, 2346 bp, Zea mays
cgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgccggtggggaggcggagggtgttcgtgcagacggagaccggctgcgtgctcggcatggacctggaccgcggggacaacgcgcacaccgtcaagcgccggctgcagctcgcgttcaacatgcccaccggcgggacctcgctcaccttcggcgatcgcgtcctggagaacgacctctccttcttacgcccggactcgccgctactgctcacccggaacagcatcaaccggagctgctccaccccgtgcctctgccccgtctccaaggacttcgagcacaaggactgcagcggactggttgagatgctcggctgctccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggagcttatgtgtatggaggccaggaagagagtagcagagtgggagcccttctctgccacagctgaacatggagaagataccgatttccagttctcggtggatatgctaggagaatacagtgatgtagtgcgatcaccaaggttcaatggctcaggttccaaagtgtccagtttcagaagccctttgtctaagctcgtcgagagcgtcgacgagggcagtgatggccatgaagatcaaaacgagtctgatcgagtcttgtatgctggatggaatacatctagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagagacactgcacgagagcgcaagggcagcagcaggtcaaaggatgaagcagcggctaggcacttcatgcaagttttgagcagggcaatagcgcatcagagaagaaaaaatatgcagtgctacttgtattgcttgcttatggagtgagtacaggatgaagatatcatcgtatgcggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataat

SEQ ID NO: 8013 - DNA, 1190 bp, Zea mays
ctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcgcgtaaatggactcatcatgtgaccactctattgttctttgtatttggtatttggtcattgtgggaaggcttcaaggaagatggagattcagaagaattggctgaagttgaagcagagctggatgatgtctttaagagtaataaaggcgaatctaaaaataaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggtggaatcatagcgcaagcactctgcactactgctgctgttcttggtggaaagagcctagcctcccagatatccgagaagatggtcgaactgtcaagcggagtgctcttcctgctgttcggtatcatgtcattgctctctggaccaggagaattgtaatccctgcttgaacccttttcagctggctgattgacatctctctctccttagacctatcttatttcagtagatgaatgatggcgacaaaagccatccatccatatggcgaaccggatggtgattcgatagtttagccgacacatcggaaacatttcactcgtccttcataaataactacatgttacagaagtctagcgatttcattctgttgtgctcagcatgtgaaagtcagtctttagtactccctccatttttttatatttgtcgcgttttagtttaaaaataaactagaagacgataaatattcgagaatgaaggtagtagaagctacatgcagtatcatgaatatgataagattcttgttactaaatttttgttgtcgcaattacatgcgttaacgaaccttagttcgtggatcaactacgcaggcaaataatacggggctttgtctt

SEQ ID NO: 8014 - DNA, 1499 bp, Zea mays
aggctgctgtctcacggctgcggctgcggcggttcgggctccagactccagggatggccgccggtgcgggaggcggcgaactggaggcgctggagggcgtgcgctccatcgtgctcaagccgtcggagtcgctcgacgagtcgcgtttcacgaggatcgccggcgccgacttcaacgacccggccatcggactccaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtgcattgcgatgcaagtatcgctttcccgcttcttgttgcagcaacatttgcacgtaaggttcataactccaaatgaacagactgaatcggattcggtggagtgaatgggcaacagaattttgttgaactctccaaatgaccttttggagcacgaggtctacttcacctgcacagggatcatgtgcaagttttttcggtgactcgcggcaaccacatgccatcattattcgatgttcacttgatgctgtactagctggttgatagcatttttgttacaactgataatttattgaaatacagacatacgattgttcatccgagtcgtctgcttacgaattttttgtagacgaaacatctgcttacgaaattgacaaatggcctgttttatgaacacattttttttcacctg

SEQ ID NO: 8015 - DNA, 1304 bp, Zea mays
gcaccaagttgtcgatcacttgcctgctcttgagctcgatcaagctatcatcagctacagcttccgatcccaactgcaactgtagcagcgacaactgccatggaggcccagaacgtggaggttgctgccctagtgcagaagatcgcggccctccacgccaacatcaccaagctgccgtcgctgaacccgtcccccgacgccaacgcgctgttcaccagcctcgtcatggcctgcgtcccgccaaaccctgtcgacgtgaccaagctcagcccggacgtccaggggatgcgagaggagctcatccgcctctgctccgacgccgagggccacctcgaggcgcactacgccgacatgctcgccgccttcgacaacccgctcgaccacctcggccgctttccctacttcagcaactacatcgacctgagcaagctagagtttgacctccttgtccgctacatcccagggctcgcgccttcccgtgtcgccttcgtcggctccggccccttgccattcagctcgctcgtgctcgccgcgcgccacctgcccaacacactgttcgacaactacgatcgatgtgccgccgccaacgaccgtgctcggaagctggtccgtgcggacaaggacctgaacgcgcgcatgtccttccacacagtcgacgtcgccaacctcacggacgagctcgccaagtacgatgtggtcttccttgccgcgctagtaggcatggcggctgaggacaaggccaaggttgttgcgcatcttggcaggcacatggcggacggagcggctctcgtcgtgcgcagcgcccacggggctcgtggcttcctctacccgatcgtcgatcctgaggacattcgtcgcggtgggttcgacgtgcttgccgtgtaccacccagacaacgaggtcatcaactccgtcatcatcgcgcgtaagatggacgcccacgccaagggtcttcagaatggacacgcgcatgcacgcggcacggtgccgatagtgagcccgccgtgcaagtgctgcaagatggaggccaacgcgctccagaagagagaggagatggcgaccacgacagagctgtccatctgatgcaaggaacttttgagcacctatgcgtgcgtggtaacaataatagttacaaatcgctgctgctgaatttctcatgcacttctttatttgatgctatgcattgtgaagtgtttaataagaatgtgttcttcctatgtgatgatatatgccaagttgctagcacttttacgtgtgatgtaacggacatcgtgtgaacagtttgatggatgggttggtttatc

SEQ ID NO: 8016 - DNA, 979 bp, Zea mays
caaatctttcagccacccgatccccaaccgcccggcccgacattccctccaaccgccgctgcggctgcgccgcccaccgccgacaggcgcagcagtcaacaggaaccgagccatggcgagcgcggatctgctgcggagggaggaggagttctactcctccctgtttgattccgccaaaggcgatggcgccaggtcgcgctcacagctgatcgagaggaagatcgaggccctggaggacatggccaccagggtcagtaaccggagatcgcggaagtggtttaacgaccgtttgctgattgaactcgtcccgcgtctttacgttgaagagatcaaaggcctattcgctcctccgccgtggggtgagcaagtgcccttgtcagcattctacagggcaaatgttggtgaatgggattccttcaggagcattgacatggatgctgaggcaagattgatgcagcatatgaaaaaatcattggaaaaacccaggaatcatgtcgatgaaggggaatcgattgcgctgaatgcttggcatcgaatagatcgacacactagagaagcaataaagagaaatttccttcctgatctgcttggaatatatgaagaacgcgttagggccttcattgaagacgctagtgacaaagatgctcttgtgctgaatgttcaggacccatttcagagactactgctccacggtgtttgtgagttctacaacgtgagctcgacaaccaccagcagtgtgagagaagatgggaggccttggaaggcaaccaccatcaagaagaggcagggcaccggcgttccctctagaatcacactagttagctttctgagaatgaagaagaatggatcgcagtaacgttagttagcgttcaagaatacaacaaaattgctttagattccgtttaggctgttgcaagacaagtgagtggtcactggcaatgtgttcttatatcgcatcagcctgctggctacggtttgg

SEQ ID NO: 8017 - DNA, 1347 bp, Zea mays
ggcgccaacaaaagaggaagagtcaggccgaatgttctgcaagtcaagacgatgtaagcagaggatctgagatagggagtcggtggtatgtggctacgcacaccttgtacttactgctaacaattcgtaaaaaaatggttttgttcaggatcttgatgatgagtctggtgggatgcgaggatcaggcggcagaggtacgaagcgcagccgcaccgcggaggtgcacaatttgtccgaaaggaggagaagggacaggatcaatgagaaaatgcgcgccctgcaagagctcatccccaactgcaacaagattgacaaagcctccatgctggatgaagcgattgagtacctcaaaaccctccagcttcaagttcagatgatggccatgggaagtggactgtgcattcctcccatgctgctgccgcgagccatgcagctgcaaattccttcaattgctcatttccatcatctcggcatgggattgggttatgggatgggtgtcctcgatatgaacagcacagcggcagttccatttcagcccatccctggcgctcactatacttgtccgatgatcccaggcacgccaccacaaggtcttggaattggaatgcctggcacaaacacgatgccagtgtttggagtccctgggcaagcaatccatccctcagcgtctagcgtacagccattcccatcgttggcgggtcttcctgttaggccaaacctggcacctcaagtcccagccgtcatggctaacatggtgcaggagcaacagcaaggcgtagcgactcagcagcagcagagtctgaataatgaagctcaacagaaagcaaataccggagatccacaaatactacaaaaatagatgaagagatcttcgccagtaatcagtttctggatggtggtggcaacaggactaatactataggggaaaatgaggctgaaacattaaaaacggtcagcaagtgccagtgtgtaacctgactcgagctaaacttgacacaaatcatggaacttggcagagcgttattatcctaatagataacatggctgatgattttcaggtctcgactaacaagctgcaggtgtgaatatcagcaccaactcatcatggaagagcttaacaagtttcatgattcacgaagcagatctatcacttgaaaaaggtccaatcaatcaagatgtatttggtggcgggatgtctagcttagcgagataagatgctccaaagttttgtgtaaaatgtagatggaaccttgttacaagtaacatttcttgacagcggtgccgttttcaggtgtttttttttttgcttcactgaagttttcttgagtcaatatatcttattttccc

SEQ ID NO: 8018 - DNA, 975 bp, Zea mays
actgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggcgatgcaggcgagggacagtaatcttcggaggggggtgcaaagttgttcgagccccaatgttttagatgctctgtgctgtcgaagctgtgccgtgctattattgtagctgatttcgtctccattcacttcttttttcttgttagtaggctggtagtggtcgaattagtaccccattgctttgtgttgccgctagtccatgtggactggtattgttcccctggatttatttggcaagcgtgtccgtgctcgctctagcgttttattgagcttttaaagtcatcgcattcttatttgattgcaatcagttattggctggat

SEQ ID NO: 8019 - DNA, 2182 bp, Zea mays
gacacgaaaccgagcaacaattgagcgatcgatccttcgcctctctctcactctctctcagcaatctatccgcaacaactaagcattcgattctccgacaacaacaagcagggcaatggcgtctgcggacgtgcacatggctggcggtgcggagacggagaccttcgcattccaggccgagatcaaccagctgctctccctcatcatcaataccttctactcgaacaaggagatcttcctcagagagctcatctccaacgcatcggatgcgcttgacaagatccgcttcgagagcctgacggacaagtcgaagctggacgcgcagccggagctcttcatccggctcgtcccggacaaggccagcaagacgctgtccatcatcgactccggcgtgggcatgaccaagtccgaccttgtcaacaacctcggcaccatcgcgcggtcgggcaccaaggagttcatggaggcgctggccgcgggcgccaccgacgtgtcgatgatcggccagttcggcgtcggcttctactccgcctacctcgtcgcggacagggtcatggtcaccaccaagcacaacgacgacgagcagtacgtgtgggagtcccaggccggcgggtccttcaccgtcacgcatgacaccacgggggagcagctcggtcggggcaccaagatcacgctcttcctcaaggacgaccagctcgagtacctggaggagcgccgcctcaaggacctcgtcaagaagcactcggagttcatcagctaccccatctacctgtggacggagaagaccaccgagaaggagatcagcgacgacgaggaggaggaggacaacaagaaggaggaggagggcgacgtcgaggaggtggacgacgaggacaaggacaccaaggataagagtaaaaagaagaagaaggtgaaggaggtgagccacgagtgggtgcagatcaacaagcagaagcccatctggctccgcaagcccgaggagatcacgcgcgacgagtacgcctccttctacaagtctctgaccaacgactgggaggaccacctcgccgtgaagcacttctcggtggaggggcagctggagttcaaggccatcctgttcgtgccccgccgcgcccccttcgacctgttcgacacgcgcaagaagctcaacaacatcaagctctacgtccgccgtgtcttcatcatggacaactgcgaggagctcatcccggagtggctgggcttcgtgaagggcgtggtggattccgacgatctgccgctcaacatctctcgcgagacgctgcagcagaacaagatcctcaaggtcatccgcaagaacctggtcaagaagtgcatcgagatgttcttcgagatcgcggagaacaaggacgactacgccaagttctacgacgccttctccaagaacatcaagctgggcatccacgaggactcgcagaaccgcgccaagctcgccgacctcctgcgctaccactccaccaagagcggcgacgagacgacgagcctcaaggactacgtgacgcgcatgaaggaggggcagaaggacatctactacatcaccggcgagagcaggaaggccgtggagaactcgccgttcctggagcgtctcaagaagaagggctacgaggtgctgttcatggtggacgccatcgacgagtacgccgtggggcagctcaaggagtacgacggcaagaagctggtgtcggcaaccaaggaaggcctaaagctggacgacgaggacgacgaggaggccaagaagcggcgggaggagcgcaagaagcggttcgaggagctgtgcaaggtgatcaaggacatcctgggcgaccgcgtcgagaaggtggtggtgtcggaccgcatcgtcgactcgccgtgctgcctggtgacgggcgagtacgggtggaccgccaacatggagcggatcatgaaggcgcaggcgctacgtgacagcagcatgagcgcgtacatgtcctccaagaagaccatggagatcaacccggacaacggcatcatggaggagctccggaagcgcgccgaggccgaccggaacgacaagtccgtcaaggacctcgtgctgctgctcttcgagacggcgctgctcacctcggggttcagcctcgacgaccccaacacgttcgcggccaggatccacaggatgctcaagctcggcctcaacatcgacgaggat

SEQ ID NO: 8020 - DNA, 1959 bp, Zea mays
atacgtacgtgaagaaccaacaggagggccgggctctcgctcgccgcgcgcacccccctctctctatctctcccgccgccgttgatctatcaccgggccgccggtccgtgactgtcgccagcggctgctggttgttgcttggttgcgtcgccgcgggagccgtgtgacccgggcgcaatgccgggagccgtgatcgtgcaccaccacacgaggtacaagacgtaccccggcgaggtcaccggcatcgccatcttctcgtgcttcatcgcctccgtcgccggctgcatcttcggctatgacatcggcctcacatccgggctgacgtcgacggagccgttcctggtcaagttcttcccctccatctacgaggagatgaagaggcaggtggtcgtcaaccagtactgcaagttcgacagccaggtcctgacgctgttcagctcctccctcttcctcgccgcgacggtggccaccttcttcgccggcccgatgacccgcgccttcgggcgcaagtggaccctgttcgccgccgcgtccgcgtacgtggtcggcgcgtgcatcggcggcgtgtccgtgaacttcccgatgctgctcacgggccgcgtcctcgttggctccggcgtcggcatctccatccaggcggccccgctctacatctccgaggtggcgccggcgcagcagcgcgggatgctcaacatcctgttccagctcatgatcacggtgggcatcctgacggcgaacatgaccaactacctggcgtccaaggtctcgggcggctggggctggcgcatccccgtgacgttcggcgccatcccggccgccgtcatcgcgctgggcgcgctcgccatcccggacaccccggcgtcgctcgtcgagcgcggggacacggccacggcgcgcaagacgctgtcccagatccggggcgtcggcgacgtgcgcgaggagttcgacgacctggccgccgcgagcgaggacgccaaggccgtgcagtgcccctggcgggagctcttcttcggcggcaagtacaagccccagctcacgttcgcgctgctcatccccttcttccagcagctcaccggcatcaacgtcatcatgttctacgcgccggtgctcttcaagacagtcggcttcaagcagaacgccaccctcgtgtcctccgtcatcaccggcctcgtcaacgtcttctccaccttcgtcgccatcgccaccgccgacaagatcggacgccgcgcgctcttcctgcagggcggcacgcagatgatcatctcccagatccttgtggggacgttcatcgggctgcagttcggcatgagcgggacgggcgacatctcggagcagtacgccatgtgcatcgtgctgttcgtgtgcgtgtacgtggccggcttcgcgtggtcgtgggggcccatggggtggctggtccccagcgagatctacccgctggccgtgcggtcggcggcgatgagcgtcacggtggccgtcaacatgttcttcacggccttcatcgggcagatcttcctcacgctgctctgccacctccgcttcggcctcttctacttcttcggcgcctgggtgctgctcatgacactcttcatcgccatgctgctcccggagaccaagagcgtgcccgttgaggagatggcgcacgtctggaagaagcactggttctggcgcaagttcgtcatcgacaccggcaacgacgcccgcaacgccgagatgaggaagaggatagcgctagagatgagctgatcatcgtcgtccatgcatgcagtctccatcgcccatgcatcatatatatgcagtaggcaggcaggcagatgaaggaaattacgtacacaagcgccaactaaaactaaacccaagtcaattacttcatatatcactcaatagctgctagaacatatatgaatggttgttgtagactgatcgtaatcccagatagttatgatatacatctttcatttt

SEQ ID NO: 8021 - DNA, 1036 bp, Triticum aestivum
gggagagcagagagctagtcgctcgcgcgggcaatccaaacctttccctattcttgcaaggtctcggaaacggaaaggcccctgctccgctgcgcgtttgcgagtttgggaagaagccttgcctgccggagggggggaaacgggcgagatggggcgagggcgcagcgagataaagaggatcgacaaccccacgcagcgccagtccaccttctacaagcgcagggacggcctcttcaagaaggcccgggagctcgccgtcctctgcgacgccgacctcctcctcctcctcttctccgcctccggcaagctctaccagtacctcgcgcccaccgtcccctctgtcaaggagttcgtcgagaggtacgaggcttcgaggcacaccaaagtttggtccgacatccgccaggagaggcgccgcgagctggagaaggtggccaagatgtgcgacctcttggagaaggaactgaggttcatgacggtggacgacggggagcggtacacggtgccgtcgctggcggcgctggagcacaacctggaggcggccatgcacaaggtgcgctccgagaaggaccgcaagatcggcggcgagatgagctacctcgagaacatgatcagggggaaacaagcggagcgctacggtctgtgtgacaagctcgctcatgctcagagcctcaaggtcgttgaaggtggatccacctcgctgaacaacggcctggacctcaaacttggattcaactaggaacgggtgaaagcttctggccgtggggttctgctctagtgttgcttttgagctcgagtgttatgtcaggttgaaatattctgcaatttccttcgaagggattgtatgaacttgtaagagaccactgtcttatgagatgtttggcttaggctggactgggctgtgcgttgtacctccaataggtggaatgtgataccagtccagtattgcaataatgtagttaacggtcaccttatgctctagttcatgcgttctttgtcaatgtggactattcgtgtttttcttgatttctgccag

SEQ ID NO: 8022 - DNA, 1980 bp, Zea mays
tggaaggtcgtctcgacatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcagaccttgtgaacaaccttggtaccattgcacgatctggcacaaaagagttcatggaggcactggctgctggtgccgacgtgtccatgattggtcagtttggtgtcggtttctactcggcataccttgttgctgagagggttgtcgtgaccaccaagcacaacgatgatgagcagtatgtatgggagtctcaggccggtggctccttcactgtcacacgtgatacctctggggagcaacttggcaggggtacaaagatgaccctttacctcaaggatgatcagttagagtatcttgaggagcgccggctgaaggatctgatcaagaagcactcagagttcatcagctacccaatctctctctggatcgagaagaccactgagaaggaaatatctgatgatgaggacgaggaagataagaaggacgaggagggcaaggttgaggatgttgatgagaaggaagaaaaggaaaagaagaagaagaagatcaaggaggtttctcatgagtggcaattggttaacaagcagaagcctatctggatgagaaagcctgaggagattaccaaagaagagtatgctgctttctacaagagcttgaccaacgactgggaggagcatctcgccgttaagcacttctctgttgagggtcagcttgagttcaaggctgtcctgtttgtgccgaagagggccccctttgacctcttcgacaccaggaagaaactgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctatgaggccttctcgaagaacctgaagcttggcatccacgaggactccacgaacaggaacaagattgcggagctgctgaggtatcactccaccaagagcggagatgagctgacaagcctcaaggactatgtgactaggatgaaggagggccagaatgacatctactacatcactggcgagagcaagaaggccgtggagaactcccccttccttgagaagctgaagaagaagggctatgaagtcctgtacatggtggacgccatcgacgagtatgctattggccagctcaaggagttcgagggcaagaagctcgtctcggccaccaaggagggcctgaagctcgatgagagtgaggatgagaagaagcggaaggaggagcttaaggagaagttcgagggcctgtgcaaggtgatcaaggaggtgctgggcgacaaggtggagaaggttgtggtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggacaacgccatcatggaggagctgcgcaagcgcgcggaggccgacaagaacgacaagtctgtcaaggaccttgtcatgcttctgttcgagacggcgctgctcacctcgggcttcagccttgacgaccccaacacct

SEQ ID NO: 8023 - DNA, 1842 bp, Zea mays
gttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaag

SEQ ID NO: 8024 - DNA, 902 bp, Zea mays
acactgggtaggaagagcgcagaaaaaggaagcagcagctttgatcgggtggagtttcttgctcactgatcgtcgagtgaagcctttgtggtccgtgacgatgtcgaggagagccgcagcgttgttgctcgcgtgcctcgtcgccgtgacagcggcggcgctggcggacggcgcgctgctcccgtggttcggcgacggccggcgcgggctcgacgaggcagcggtgaccgacgtgggcctcctggcggccgacccgttccggatcctggagcacgtccccttcggcttcgaccgggacgacgtggccatggtctccatggcgcgcgtggactggcgcgagacccccgacgcgcacgagatcgtggtcgacgtgcccgggatgcgcagggaggacctcaggatcgaggtcgaggacaacagggtgctgcgcgtcagcggcgagcggcggcgcgctgaggagcgcaagggcgaccactggcaccgcgaggagcgctcctacggcaggttctggcgccggttccgcctccccgagaacgccgacctcgactccgtcgccgccagcctcgacagcggcgtcctcaccgtgcgattcaggaagctggcgcccgagcagatcaagggcccgcgcgtcgtcgggatcgccggaggagacggtggcgccgaggcgaaggagagcatcggaactggcgccggagatggtcatcagaccaagaaggtggagctctgaacagtgaggtgggaattgggatgactcaatgacggagatggctctgcgcgtgtgcgtagttttactagtttatgtgttcgcgtttttcttttttgtgacagcgtatatgcacttgtatggagtggaagtgtgccatgttttactgaggaataaaaacctacagtactagtgtact

SEQ ID NO: 8025 - DNA, 1627 bp, Zea mays
tccaaaagaaactcctgataaatataaaaaggaggggaaaaagaaaaacacttgcagcggcatccaccaccggagctcccatcatcggtctatccctccgtgtcaaccccctcctcagaagttctaattgcagttcagcccctggccggtccgccgggccaccggaaggagccgctcgccggaggaagccccccatctccttgccctgcggcgggtttatggggttctcgctgtaccccatgaagacgtccacgcggttgctctggagcactagcttcttccgccataagctcagctcctcctcctgcttcctctgagcccgccccacccgcgtcgatcacctcggcggcggcccgctgttgctgcgcggtcctagcacccgttcgagtgtgtgtgtttgtgttctttgagtttcaagattgggttttgttgcgttattggggagacgaagggactaaggcgcagtgagcggacaagaatcagcatggatccgagcgcggtcagtttcgactctggcggcacgcggcggggcggcggcgcgcagatgctgctcttcggcggcggaggcagcgccaacagcaacggcttcttccgaggtgttccgatggcggtcctgggcatggacgacgcgacgcgcgtgggcaagcgggccttcttcacgacacacgaggagctcctagaggaggagtactacgacgagcaggcgccggagaagaagcgccgactgacggcggagcaggtgcagctgctggagcggagcttcgaagaagagaacaagctggagccggagcgcaagaccgagctggctcgccgcctggggatggcgccccgccaggtagctgtttggttccagaaccgccgcgcgcgctggaagaccaagcaactcgagaccgactatgaccgcctcaaggctgcttacgacgcactcgccgccgaccaccagggcctcctggccgacaacgataacctccgggcacaggtgatctccctgacggagaagctgcaaggcaaggagacatacccgtcggcaaccactgctgcccaagaggtcgaccagccagacgaacacaccgctgtgtcaggcacggaagaactgctggcgcagcagctcaaggacaacctccacagcagcggcgactgcactggccatggcaccctctcttcggaagaagacgacggtggcgtggtcagtgacgagggctgcagcttcgctctcccggatgccatgttcgctgccgggttcacccaccatggcgccgaggaggtgcagctggccaactggacatccatgttctggaactgatcagcggatggatgcatccaagtgcaaagatcggatcctctcctcgtctcgacccttttctgcagcatataattaccgtgttaattatgtgccgtccgatgtttttaagtgctcatgttttaagtttgtgtttttttgaagattttgtatgttcatatatataataatgtgcttcgaacatgacactcgaaaagttgaataattggacatgtcgacctgctgtgcactagcagctggcatgttttgtttagggctggtttgggaagttcatttttcaaagaattcatatttttcaaagggaaatgaactaattttacttaggaa

SEQ ID NO: 8026 - DNA, 1512 bp, Zea mays
gaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgctgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatcgacaccggcagcgacgtgtcgtgggtgcagtgcaagccgtgctcgcagtgccactcccaggcggacccactcttcgaccccagctcgtcgagcacgtactccccgttctcctgcggctccgccgcctgcgcgcagctcggccaggaaggcaacggctgctcctccagctcccagtgccagtacattgtcacgtacggcgacggctccagcaccacggggacctacagctccgacacgctcgcgctgggctccagcgccgtcaagagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacgccgagctcctccgggttcctcacgctcggcgctgctggcggtagcggaacctcgggcttcgtcaagacgccgatgctcaggagcagccaggtccccacgttctacggcgtgcgcctccaggccatccgggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcggccaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacat

SEQ ID NO: 8027 - DNA, 1478 bp, Zea mays
cgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacatcaccgcgggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctcagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccgcgagtggagtcactcatccaggaggttaagaaggtgactaacaagcccgttgctgttggcttcggcatatccaagccagagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgaccgaccaataaaaataagccaagtggaagtgaagcttagctgtatatacaccgtacgtcgtcgtcgtcgttccggatcgatctcggccggctagctagcagaacgtgtacgtagtagtatgtaatgcatggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgtat

SEQ ID NO: 8028 - DNA, 3972 bp, Zea mays
cgtagcactgccctcttcctctctgtcctctcccctgctgccgccccctttcccaaatctggccgcacgacgcaccagccaccaaccgcacacaccccaaacttgaaggcacaacccgagcgctcgcccgcctcgcctctgcgccgcgtccggccgccggtagcgggccggtcacttaccgggagggagaggtgctttggttcctggatgagctgtgaaggaactgggagcaagaagaattgatgtttactccgcagggcaaaggatggaccggctggtcgacgccaactccggccaaccagcggagcggtggtggggctcctgctgcgtcggcgccccttggaaagggcaaaggaagggtcgccgagctcgagcaggagttgcatgaatatcagtacaatatggggcttcttttgattgaaaagaaagaatgggcagcaaaatttgaagaaatcagtgaagtgctgacacagaaagaggagatactgaagagggagcaggcggcacatctgaatgctatatcagagtatgaaaggcgggaggagaacatgcggaaagcactaggtgttgagaagcaatgtgtcgctgatcttgaaaaagccttgcgtgatatacgagcagagatagctgaggttaaatttacatctgagaaaaagataacagatgctcagtctcttgaggctagtttggaggaaaaatccttggagatcgagggaaaacttcatgctgcagatgccaaacttgcagaggcaaaccgcaagaagtctcaagctgaccgtgatttagaagaggcggaagctcgtcaacgtagactggagaaggagaaactgtattttgagacagagcggaaggcccgagaaaagcaacttaaggagcaggaggaatcactgcaggaatgggagaaaaagctgaaggaaagtcagaatagacttaatgagttgcagagatctataaatgagcgagaggagagagcaaataagaatgatcaacttttcaagataaaacaggacgaactggaggaggcacgaaggacagtggaggccgctaaagttactctgaaagtcaaagaggatgatattaacaaaagactaaatgaattacatttacaggaaaaggatgctgactcaaagcgcagtgcattggaagagcaggggaaaaaattggatgagagagaggcaaaggtcactaatagagaaaaggaggggctccagaagcttcttgaggatcatcaggtggagcttgaatccaaaagacgggattttgaattagaattagagagggaaaggaaatcttttgatcaaaatatgacacagaagcaagcggatttattgaaaagggagaaagatgttaaatctttggaggctaaactttctaaaagtgagcaggcattgaatgataagaagaaatcaatggaaaacttgcagaatgatcttgatgccaaatctaaggctctgaagagttgggatgaatcattgaaaaatgacgagaaaaggttactgaaagaaaagcagcaaatggatcatgaaagagaacaattggagacatacaaattggagcttgaaaagatcaaatcagcattagaagctgagaaggaaaaaatatcagaagagcagaataatctgaaactcacagcgcaagagaggcaggagcatagcttgttgatagcaaaacttaagaaggagattgaggaatacagaatgcgaagcaactccctatctgaggaaatggaggatttaaggaagcaacggcagaaatttgaagaagagtgggaacaactagacgaaaagagagccctccttgtagaggaggacaaaaggttgaacattgagaggatgaatttagaacggtggcgtgacaacgaagaaaaaaggttaaatgatatgaaactcaaaatggatgaagaatacaagcagcagctggagagtcttgagcgcaaggaaaaggctttgagtgatgatatgaagcacaagcaaatggaaaatgatgaatttctgaagggagaacgtgctgatgttcaacgtaaattgcaactcaaacggcatgaattggagatggagatggagcaaaaacaagccacgaaggagaaggaactggaagaaaaggaaaatgagttaaataagaaaatagattttgtggaaaataaactccgacatgcaattgagttgaatgagtccaagattgagaagttattattggagaaaagggaggtgcagatggaaagagaattactgctggaggaaagaaagaaaacggagactgacaaggcagatattagaagggatattgagagtctgcactcattgagcaagagtttgaaggaacgtcgagaggcatataacagggacaggagcagactcatcgaactatttgaaaagtacaaggcgtgcaaaaactgtgggatttctatttttgagggattggattctctgctgcttaaagacagtgctgaaattgagcatccaagtttggctgttgagggagatgatcatgccttgaccaccgatacatcaggtccagatacaggaacccttgttaattcaggtggtcgtttttctttgttacagaagtgttcaaggcttttcaagttctcccctagaaaaaagggtgagcagtcatcagaacaaccatcagagaggaatatatcttttggtgcaagactcgaggaagcaacacagagcgatggagattatgtgccaactcctgtctatgagatagcccacgattctttcaatgcagaggatgagctcccttctgacggtgaaaccagggagaatgaagagtctgaaaggcatgacatagctgataatgcccagatggagtcttctgttggtgtagcagataacagtatagatattctcggtactaagtcatttgatggtgctaacgacatggcagttgaagcaactattgtctctgttgatcaaaatggcgaggactctgtagttcctgctgaagcaggtgtagagcctgaaacatcagagcaaggtcggcgccagcaaaaccagagaggcagaagaaaaggtggtatgaaaagaacacggtctgttaatgctgtagttgaagatgctaagatgatacttggcgaggtttttgaggagaagactgatgatcagggagatacagtcaaggtgggtgctacacgaaagcggcggtttgctggagctacaataagtgaacaagatgaagaagggagcgaagcacattcagaaagtgtttcacttggagggcagcgccgtaagaggcggcaaactgctggggcagtgacagatgccccaggagaaagacgttacaatttgagacacagtagagctgcaaatgctggcgctgcaacagcccaagcagacaaaaaaaaaatcttcaaaagcaagaaataaacatacagtagaagcttctgctgatgacaccgaaggaacatcaaaggttgttgaggaacctgcccctgagagcaagagggtatctgaatctgcagactacgatgcatcccagttgcatgagttttcccaggttgaagttggtgatgcccatgctgtagacggtgagggtgctggtgaggaagatggtgatattttggatggccaagatgcactgcctgatgtgccaatgacaccttctggaagcgagtttggagcggaacaggaagatgaggacgatgatgattcagagaggcgaaaccaatcaatcagcaagaagctatggtcattcttcactacatgacttgctgaagaggtcgtcatgtaggttatttctagcttttgtggtttcgattcatgataccccattcttggaactgtaggtcgtgtgcttttggtgattatgtactagatctcccacttgattgtgcttctctcccgtgtaattgaaatatatttgtagtggacatagtttgatggcactcacagaagtagctgatgagatgtacaatggcgatgatggtatgccctgtaaggctgtaacaccagtagcttggtttgt

SEQ ID NO: 8029 - DNA, 974 bp, Zea mays
ctttcagttcagccgagcaccatcgtcacagtcagtagccaagcatatttctttctccgactccgagtgatttgcgctgaacgatcagtttccagagcgagcggagctgagcgagcttgcgttgcttgagagaccctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcggctacctgggaaagaagaccgacgaggccaagcacaaggccggcgagacgacggaggcgaccaagcagaaggccagcgagacgacggaggcgaccaagcagaaggccggcgagacgacggaggccgctaggcagaaggcagccgacgccatggaggcagccaagcagaaggccgccgaggccgggcagtacgccaaggacaccgccgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaccaacaaggactcctctaccatcaccagggatcactagacgcgtgtatgcacacgcagcacttggtccgatcctgtcgtccgtgaccctgtttgcttgttcgcgagtccagtatagggttgtgcatgtgtttcagtgtcatggtttccttttctacgaaatttggtgttgtaagtttgattcgcatgtacgttgctgtgttttttctgcgtcatcatgtctgtaaacgagtcgggcgggtttgagtgtcctttgttgtgataataaagttggtaaatcgtaatt

SEQ ID NO: 8030 - DNA, 922 bp, Zea mays
gcgcagaaaaaggaagcagcagctttgatcgggtggagtttcttgctcactgatcgtcgagttcctgttcgatcgaagttccaggtgcgcacgtacgcactgaagcctttggggtccgtgacgatgtcgaggagagccgcagcgttgttgctcgcgtgcctcgtcgccgtgacagcggcggcgctggcggacggcgcgctgctcccgtggttcggcggcggccggcgcgggctcgacgaggcagcggtgtccgacgtgggcctcctggcggccgacccgttccggatcctggagcacgtcccgttcggcttcgaccgggacgacgtggccatggtctccatggcgcgcgtggactggcgcgagacccccgacgcgcacgagatcgtggtcgacgtgcccgggatgcgcagggaggacctcaggatcgaggtcgaggacaacagggtgctgcgcgtcagcggcgagcggcggcgcgcggaggagcgcaagggcgaccactggcaccgcgaggagcgctcctacggcaggttctggcgccggttccgcctccccgagaacgccgacctcgactccgtcgccgccagcctcgacagcggcgtcctcaccgtgcgattcaggaagctggcgcccgagcagatcaagggcccgcgcgtcgtcgggatcgccggaggagacggtggcgccgaggcgaaggagagcatcggaactggcgccggagatggtcatcagaccaagaaggtggagctctgaacagtgaggtgggaattgggatgactcaatgacggagatggctctgcgcgtgtgcgtagttttactagtttatgtgttcgcgtttttcttttttgtgacagcgtatatgcacttgtatggagtggaagtgtgccatgttttactgaggaataaaaacctacagtactagtgt

SEQ ID NO: 8031 - DNA, 818 bp, Zea mays
cacacaacagcagctcaaaaacctaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaaacccaagaccatcgaggtcaaggtcgcctgaggtgggactaggtcgaccgatcgtggctctgaagatgtgggagcagtgccagcgagttgtgaggacctctacctgtgtggaatgtggcgaggaataatcgtagtctgtagtgggggtgcttctggtgtgcgtgtttgcgttccttcggtctcggtgtctgtctaccaattcctatctgatgtatcggcttcggtttcgtatgaaccatgccggatgctttcagtatgttcatct

SEQ ID NO: 8032 - DNA, 1679 bp, Zea mays
cttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatcgacaccggcagcgacgtgtcgtgggtgcagtgcaagccgtgctcgcagtgccactcccaggcggacccactcttcgaccccagctcgtcgagcacgtactccccgttctcctgcggctccgccgactgcgcgcagctcggccaggaaggcaacggctgctcctccagctcccagtgccagtacattgtcacgtacggcgacggctccagcaccacggggacctacagctccgacacgctcgccctgggctccagcgccgtcaggagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacaccgagctcctccgggttcctcacgctcggcgctgctggcggtagcggaacctcgggcttcgtcaagacgccgatgctcaggagcagccaggtccccacgttctacggcgtgcgcctccaggccatcagggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcgggcaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacatatacatactacttcgattttaattatctttgcgatagcatgcaataacgtcatgcatgcaagtgtgcaaactactaaaagctaaaagataatcttaatgtcacctgattgatgactataaaagattaatgatatattattgtattgcgcttggtgcgatgattaattatggtgtatacagccttttgggcgagctaatgttccttatatattactcactccgtctc

SEQ ID NO: 8033 - DNA, 1371 bp, Zea mays
ctcgcccgctcagtcacaaagcctcagatctcagtcgcctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagttgctgagcatgctgcagcaaataacaaggtgttcctgatgaacctctctgctcccttcatctgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcgactatggacgtctcctttgtcgctgtataaggcatgatttgccatcattctgttgcttcggtgatgcttgcaatgcaatgagaatgtgttggaacgatagatgctcttgatc

SEQ ID NO: 8034 - DNA, 1318 bp, Zea mays
aacaggcaaggcaagatggtgcagcaacagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcagcgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactcggacccggtggcgctcggccactacatggtgcagcagctcaacaggcatagcggcttgctctactgccacatggtggagccccgcattaccgcccacgggcgcaggcagatccctcacgggctcttgccgttccgaaaggcgtttcatggaacgttcatcgccgccggtgggtacgatcgggaggaaggcaacaaggtggtggcagaagggtatgctgacctcgtcgcgtatgggaagctgttcttggctaacccggacctgcctaggaggttcgagctggatgtggcactcaacaaatacgaccgctccaccttctacacgcaagatcctattgttggctacacagattaccctttctttgaagaagaagatggcaagaatgagaggtgaaatctgataatgtggagggttcatcaagtataagttcgtcattatttccaccattcattattggtcattgtggtggagtcattgtgtcatgttgtttcattctgtactagtgtggtgtgaagtgaaataaatctatttggtgaaattgttataaaataaattatagacttgtcgg

SEQ ID NO: 8035 - DNA, 839 bp, Zea mays
ggcagtcttcccccaagacgtctaaaccccaatccctaaatccccgacgcagaccacacgacgcgcacctccgttcacgaggcggaagcatgagtcgccacccgatcactaagtgggcacagaggtccgacagggtgttcttgacgatagagctgcccgacgcccaggatgtgaagctgaacttgaagcctgaaggccatttcaacttctcagctaagggctcagatgacttgcgctatgagtttgacattgagctgtttgatgctgtgaatgtggaggagagcaaagcagctattgccccaaggaccatatgctacctgataaagaaagctaagagcgggtggtggccaaggctgctgaagcaggagggcaaaccacctgtgttcttgaaggttgattgggacaaatggcaggacgaggatgatgaagacgctggatttaatgactttggtggtatggacttctcgaaactggacataggaggtgctgatgacgacgatattggggatgatgaagatgatgtggttgaaagtgctaacaaagatgaagaaggaggtaagacagaagagagcaaggaggaggaagcagctcctgcggctgcagaggaagtgaagccatgaagaatcatttgactttgctccgcgccatgggtgtccacggtatctagctaggctagacgttcccttggatttttggtgtaaaatctggaggtcgaaccactcactgcctattgaagtaaaggatacaaaaacagttgtgctgtcttagtttttggctgaaccctgtgaactgctgctacaatatttggtcagagtttatatgcatccatcatgcgacgc

SEQ ID NO: 8036 - DNA, 3046 bp, Zea mays
gccgaagcaaatccattccacaagcacctggtgggatcatctcatcatcagaaaccaagagagagattccgtgcccgcttgtagattgtgaggactgaggaccgagaagcagccatgaatccggacaacttcacccacaagacgaacgaggcgatcgtgggggcgcacgagattgcggtggaggccggccacgcgcagctcacgccgctgcacctggccgcagtgctggctgcggacaagggcggcatcctgcggcaggccatcacgggggcgtcggggggcgacggagcggccggggactcgttcgagcgcgtgctgaacaactcgctcaagaagctgccgtcgcagtccccgccgccggactccgtcccggcgtccacggcgctgatcaaggtcatccgccgggcgcagtccgcgcagaagaaacgcggggactcgcacctcgccgtcgaccagctgctgctcggcctgctcgaggattcgcagatctccgactgcctcaaggaggccggcgtgtccgcggcgcgggtgcgcgccgagcttgagaagctccgcggcggggaggggcgccgcgtggagtctgcctcgggggacaccaacttccaggctctcaagacatacggccgggacctcgtcgagcaggccgggaagctggaccccgtcatcggccgcgacgaggagatccgccgcgtggtgcgcatcctctcgcgccgcaccaagaacaaccccgtcctcatcggcgagcccggcgttggcaagacggccgtcgtggagggcctcgcgcagcgcatcgttcgcggcgacgtgcccagtaacctcctcgacgtccgcctcatcgcgctcgacatgggcgcgctcgtcgcgggcgccaagtaccgcggcgagttcgaggagcggctcaaggccgtgctcaaggaggtggaggaggccgaggggaaggtcattctcttcattgacgagatacacctcgtcctgggcgcgggcaggacggagggttccatggacgcggccaacctgttcaagccaatgctggcgaggggacagctcaggtgcatcggcgccaccacgctggaggagtaccgcaagtacgtggagaaggacgccgcgttcgagcggcggttccagcaggtgttcgtcgcggagccgagcgtgcccgacaccgtcagcattctgaggggactcaaggagaagtacgaggggcaccatggcgtgaggatccaggaccgcgccctcgtggtcgcggcacagctctccgcgaggtacatcatgggtcggcacctgcctgataaagccatagacctggtggacgaggcctgcgccaatgtgagggtgcagctcgacagccagccggaggagattgataacctggagaggaagagaatccagcttgaggtcgagctccacgcgctcgagaaggagaaggacaaggccagcaaagcccggctgattgaggtcaggaaggaattggacgatctgagggacaagctgcagcccctgaccatgaagtacaggaaggagaaggagagaatcgatgagatcaggaagctgaagcagcgccgcgaggagctccagttcaccctgcaggaggccgagcgccggatggacctggcccgtgtggccgacctcaagtacggcgccctccaggaaatcgacgccgcgatctccaagctggagagcgaaacaggggagaacctgatgctcaccgaaaccgtcggccctgaacaaattgcagaggtggtgagccgttggacgggtattccagtgacccggcttggccagaacgacaaggagaggctggtcggcctggctgacaggcttcaccagagggtggtcggccagacagaggctgtgagcgccgtcgcagaggcggtgctgaggtcgagggccggtcttggcaggccacaacagcccactggctcgttcctgttcctgggtccgactggcgtggggaaaactgagctagccaaggccctagccgaacagctgttcgacgacgagaaccttcttgtccgcatcgacatgtcggagtacatggagcagcactcggttgctcgcctcatcggagcaccgcctggctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacactgtgatcatcatgacatcgaacctcggcgccgagcacctcctcgctgggatggtgggcaagaactccatgaaggtcgctcgcgatctggtcatgcaggaggtgaggaggcacttccgccctgagctgctgaaccgtctcgacgagatcgtgatcttcgatcctctgtcccacgagcagctgaggaaggtcgctcgccttcagatgaaggatgtggccgtccgtcttgccgaaaggggcatcgctctggctgtgaccgacgccgcattggacatcatcttgtctctctcttacgatccggtgtatggcgcgcggccaatcaggaggtggatcgagaagagggtggtgacgcagctgtcgaagatgctgatccaggaggagatcgacgagaactgcacggtctacatcgacgccgcgcccggcaaggacgagctggtctacagggtggaccggagcggcggtctggtgaacgctgagacggggatgaagtcggacatcctgatccaggtccccaacagctccaccaggagcgacgctgcgcaggccgtcaagaagatgaggatcatggaggaggacgaggacggcatggacgaggagtaaaaggcgggccggaggacgcggagctgcgcccaggccgcaggtctggcgccggcatcatcgagtgtcttttgaataagcgtgtagataagcccgtgaatatgcagacgaggttgagatgatgttcttgtaacgctgctgtttgtcaagcatggacgaatggtctctcatatagtatcaaagtgacaagtctctc

SEQ ID NO: 8037 - DNA, 2172 bp, Zea mays
gggaaacagatcgggtggcggcaaccggtagccggttcggctggcacgatgggcggcgaggccgagggcggggagcggcggctggggcgggtcctgagctttgggatcccggacacggcgctggggctagtgatggggtacgtggaggacccctgggaccgcgacgccatctcgctggtgtgccgccactggtgccgcgtcgacgcgctcagccgcaagcacgtcacggtggccatggcctactccacaacacccgagcgcctgttcggccgcttcccgtgcctcgagtcactcaagctcaaagcaaagccccgcgcggccatgttcaacctcatctccgacgactggggcgggtctgcgtcgccgtggatccgacagctctcggccactttccactccctcaagaagctccacctgcgcaggatgatagtatccaatgacgacatcaacacgctcgtccgcgccaaagcccatatgcttgtgtcgctgaagctcgaccgctgctcaggcttctccacgccctccatcgcactcatcgcccgctcttgcaggaaactggaaacacttttcctggaagaaagcatgattgatgagaaagaaaatgatgaatggatccgtgagcttgctacgagcaattctgttcttgagacactgaatttctttcagacagatctcagggcatccccagagtatcttacccttcttgtgcgcaactgtcaaaggctgaaaaccctgaagattagtgagtgtttcatgcctgatctggttagtttgttccgaactgcacaaacactacaagaattcgctggtggttcctttgaagatcagggtcaacctgtggcaggtagaaattatgagaactactattttcctcctttactgcaccgcttgagtttgctctacatgggaacaaatgagatgcagatactgtttccatatgctgctgcacttaagaagttagaccttcagtttacattcctttccacagaggatcactgtcagatagttcagcgctgccccaatctggaaaccttagaggtgagggatgtcataggggatcgtgggctacaagttgttgcagagacctgcaagaaattgcagaggctcagagtagagagaggagatgatgatcaaggaggtcttgaggatgaacaaggtaggatttcacaggttggggtgatggctatagcccaaggctgccctgagttgacatactgggcaatatatgtatcggacattacaaatgcagctctagaagcggttggtacatgcagcagaaatcttaatgatttccgccttgtccttcttgatagagaagcacatataactgagttgccactggacaatggggttcgtgctttgcttagaggttgcaccaaactcaggaggtttgcattttatgtgagacctggggtcctatctgatgttggtcttggctatgttggagaatttagcaagagcattcgatatatgttgcttggcaatgttggtgaatctgataatggaattatacaattatcaaaaggctgcccaagcttgcaaaaactggagctgaggggttgtttgtttagtgagcatgctttagctatggctgcactagagctcaagtcactgaggtatctgtgggtgcaaggattcaggtcatctccaaccggaactgatcttatggcaatggtacgccccttctggaacattgagtatattcttccagaccaagatgaaccttgcccagagtataagaaacagattctggcatactactcccttgctggaaggaggacagattgccctccatcggtaactccactttacccagcagtttgagcgtagatacttgctttttgccagactgaatctcatggtactaagctccattgctcccacaatctgtgaaatcgatggttcctgttgatggggacatgcagacgttccattgcacataaccccagagctaagctttaagcaggacgacagctcggaactgaggctagctgagaacaatcgtgaatacctgaaggcagcactttgtggatcagattggcctacctgtccagtatggaaatgtaaacttcaccattttgaatagttttggagaaacaattttgtaataatttacccttgtttagtgtacattatcgattttcgattatatgatgttgtattgctttattt

SEQ ID NO: 8038 - DNA, 972 bp, Zea mays
aagcgcttcgcaagcacaggcagtgatcggcaaccaaatccggacagtcttgagctctctcagtctcagcatttcagttcccagattcacatagccccagccccacaagtagcgaaatggcagctgctccgttcgcgattgccggccggctctcccccgttgcgcgcctcccggtccgcgcctggaggccggcgcacgggtttgcgtcgtccgggagagcccgctcgctcgccgtggcgtccgcggcgcaggagaacagggacaacagtgtcgacgtacaggttagccagaacggcggcaacaggcagcagggcaacgccgtgcagcgccgcccgcgccgcgcgacagcgctcgacatctccccatccccgttcgggttagttgatccgatgtcgccgatgcggacgatgcggcagatgctggacacgatggacaggctgttcgacgacgccgtggggttccccatggggacacggaggtccccggcgaccaccggcgacgtacgcctgccgtgggacatcgtggaggacgagaaggaggtgaagatgcggatcgacatgccgggcctcgcgcgcgacgaggtgaaggtgatggtggaggacgacacgctggtcatccgaggggagcacaagaaggaggagggcgcggagggcggcagcggtggcgacggcgacgggtggtggaagcagcgcagcgtgagctcctacgacatgcggctggcgctgccggatgagtgcgacaagagcaaggtgcgggccgagctcaagaacggcgtgctcctcgtcaccgtgcccaagaccgaggtggagcgcaaggtcatcgacgtgcaggtccagtagacaaactgagctgtcacgacgggtctttgtgtagcactagcgtgggttgggctcttcgcgccgaccgtatcagtactcgtgacccaacgtgtggaataatgtgaataaataaacgcttcaattctgctattcc

SEQ ID NO: 8039 - DNA, 1990 bp, Zea mays
cgcagctctagagcctccatgggcagctacgcgtacaagtactgcatgtgcttcacgcgcaagttccgatccccggacgcccagccgccgccggacgtccgcgccgcccacctctccttcgcctctgacgcccatgccctccgccgcttcgtcgccggcgtccagggcgagtcccccgccgacgtcgaccgcatcctcgccatgctctccgggggccacagccatggaatcgcccgcctcgtcacaaggtcgccggcggcatccacgcccacgctcgaagacttcttggccttcctcttctcccccgacctcaacccacccatcgcgcaccaggttcaccaggacatgtcagcgccgttctctcactatttcgtgttcaccgggcataattcctacctcactgggaaccagctcaatagtgactccagtgacgtcccaattgtaaaggcgttgcagggaggtgttagagtcattgaactcgatatgtggcccaatccttcaaaggacaatgtcgatattcttcatggagggacattgactgccccagtggaaatgatcaaatgtttgaagtccatcaaagaatacgccttctgtgcctcaaattatcctcttgttattactcttgaggatcacctcacaccagatctccaagctaaagttgctacgatgctcactgaaacatttggagatcttcttttcgtccctaatccagacccgatgaaagagtttccttctccagcatctctaatgaagagaataatcatatcaaccaaacctccacaagaatataaggagtttctcaaagctgagaataatcgcagtggcagcggaaacatagctgagttgccagaccaaggaagcctgagaagaatagattcaaatgccgatgaatctgatggaaaggatgaactggatgagcaagacgaggaagactccgactccgacgatcccaaatttcagcaggatacagcctgtgagtataggaaactcatcaccatccaagctggcaaaccaaaaggccatttgcgggatgcgctaaaagtggatccagataaagtcaggcggctttctttgagcgagacacagttagctaaagcgacaatctctcatggtgctgaagtcataaggttcacacagaagaatatactccgtgtgtatccaaagggcacgagggttaattcttcaaactacgatccaatgaacgcctggacccatggtgcgcagatggttgcattcaacatgcagggccatgataaagcgctccggttgatgcaagggtttttcagagccaatgggggctgtggttatgttaaaaagcctgacttcttgctaagaacaggcccaaatggggaagtatttgaccccaaggctagtttgccagtgaagaaaaccctcaaggtgaaagtatatatgggagacgggtggcgcatggacttcagtaaaactcatttcgatgccttttcgcctccagatttctatactagggtagggatcgcaggtgtgaaggcagacagtgtgatgaagaagacaagggtgattgaggaccagtgggtgccgatgtgggatgaggagttcacgttccttctgacggttccggagctggccctcctgagggtagaggtccaggagtacgacatgtcggagaagcacgacttcggggggcagacagtgttgccggtatgggagctgaagcagggcatccgtgctgtgcccctgcacgatcgcaagggtgtcaggtacaagtccgtcaggctcctcatgcgatttgattttgtgtagccgagccgagccgccattcagattcagcttcttctttttttcccttcttgtgtgaattgaatgtattactcccttccttccatcttcaacgtatatgtgtatgtatgtacttatttttgtcggaataaaagttgtatggaatggaatggaaggaaggagtagaactgtcttcaaactccagcttctagatctgtacgggtgattcagtttt

SEQ ID NO: 8040 - DNA, 1685 bp, Zea mays
gcccgggccgactccactccaatccaatcctggggcgggcgactgcctccttccctcgatctattctccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagcctcaaggatgcgttcagcaaattcggcaacctcactgaggcaaaggtggttcttgacaaattttcaggacgttctcgtggtttcggctttgtaacttttgatgagaagcaagccatggaggatgctattgagggaatgaatggactggacttggacgggaggaacatcactgttgataaagctcagccacaaggacctggtagagaccgtaatggtgaccgtgattatgaccgcgagcgtggatctcgttatgaacgtggtcgtgactatggtggtgggcgtgcaccgcgaggtggtggtggtggtggtggtggtggtgactgcttcaagtgtgggaaacctggtcattttgctagagagtgcccatctggggatggtgggagaggggacagatatggtgggagagatgacaggtatggtggcggtggcggtggcggtggcggtcgttatggttctgaccgtggtggtgaccgatactctggccgtagccgagatggcggcagctatgggggtggcgatcgctacagccgtgaccgatcaggtccttactgatggccttagttcttgattgagaagtatgtgccatccaggcatatgacttggtcatagtgcttggcgcttggatcctgcatgtttgcttgatgtgctatttggctattaaaagatggattttgtcactgtgtttgatgaccctggtcctaattaagcttatgcctgtgatacgggggattggatggcaagttagtgtccgcatttgtgttcttttcggggaagcaaggggttgactactataatctacttgaacacacctacagctacaagaaaaaactatgttcttgttacctcttctgaaagcaagtgatgaatcgtccattagagaaaattaactggcttctttttggttatttgttcttgttgtggattggttgatactgtggttctggatttggttacttgcgtcctaagatcattttagtctggccagttgatccacgaatgcaaagagattatcctttggttccattctatgtgcctttagcattggagggcctctatttatggttgcttgatgaactggttatgtttgcttcgccatgttggtggggtgttccttgagctgtcccgtgttccttgtgacttgtgagaacaccagaggttatgcttgcctgagtggatgtgatgctacctggttgctgttcctttgacaatgcaccaatgtcctatcgcagcttatatactctggttccagattaattactggtgcccctttgagaggagttatgatgatgttattattcatcagcagcattctaattgcccttgatttagtgtagcctttttttcttagttcaccgaatctcaggatgcaaacgttaggttacttttactgttcgtactaaccaattgagcttttgtactaaaaaaagtatgttacattaagctgctccaggttccgttt

SEQ ID NO: 8041 - DNA, 2185 bp, Zea mays
cgtgacacgaaaccgagcaacaattgagcgatcgatccttcgcctctctctcactctctctcagcaatctatccgcaacaactaagcattcgattctccgacaacaacaagcagggcaatggcgtctgcggacgtgcacatggctggcggtgcggagacggagaccttcgcattccaggccgagatcaaccagctgctctccctcatcatcaataccttctactcgaacaaggagatcttcctcagagagctcatctccaacgcatcggatgcgcttgacaagatccgcttcgagagcctgacggacaagtcgaagctggacgcgcagccggagctcttcatccggctcgtcccggacaaggccagcaagacgctgtccatcatcgactccggcgtgggcatgaccaagtccgaccttgtcaacaacctcggcaccatcgcgcggtcgggcaccaaggagttcatggaggcgctggccgcgggcgccaccgacgtgtcgatgatcggccagttcggcgtcggcttctactccgcctacctcgtcgcggacagggtcatggtcaccaccaagcacaacgacgacgagcagtacgtgtgggagtcccaggccggcgggtccttcaccgtcacgcatgacaccacgggggagcagctcggtcggggcaccaagatcacgctcttcctcaaggacgaccagctcgagtacctggaggagcgccgcctcaaggacctcgtcaagaagcactcggagttcatcagctaccccatctacctgtggacggagaagaccaccgagaaggagatcagcgacgacgaggaggaggaggacaacaagaaggaggaggagggcgacgtcgaggaggtggacgacgaggacaaggacaccaaggataagagtaaaaagaagaagaaggtgaaggaggtgagccacgagtgggtgcagatcaacaagcagaagcccatctggctccgcaagcccgaggagatcacgcgcgacgagtacgcctccttctacaagtctctgaccaacgactgggaggaccacctcgccgtgaagcacttctcggtggaggggcagctggagttcaaggccatcctgttcgtgccccgccgcgcccccttcgacctgttcgacacgcgcaagaagctcaacaacatcaagctctacgtccgccgtgtcttcatcatggacaactgcgaggagctcatcccggagtggctgggcttcgtgaagggcgtggtggattccgacgatctgccgctcaacatctctcgcgagacgctgcagcagaacaagatcctcaaggtcatccgcaagaacctggtcaagaagtgcatcgagatgttcttcgagatcgcggagaacaaggacgactacgccaagttctacgacgccttctccaagaacatcaagctgggcatccacgaggactcgcagaaccgcgccaagctcgccgacctcctgcgctaccactccaccaagagcggcgacgagacgacgagcctcaaggactacgtgacgcgcatgaaggaggggcagaaggacatctactacatcaccggcgagagcaggaaggccgtggagaactcgccgttcctggagcgtctcaagaagaagggctacgaggtgctgttcatggtggacgccatcgacgagtacgccgtggggcagctcaaggagtacgacggcaagaagctggtgtcggcaaccaaggaaggcctaaagctggacgacgaggacgacgaggaggccaagaagcggcgggaggagcgcaagaagcggttcgaggagctgtgcaaggtgatcaaggacatcctgggcgaccgcgtcgagaaggtggtggtgtcggaccgcatcgtcgactcgccgtgctgcctggtgacgggcgagtacgggtggaccgccaacatggagcggatcatgaaggcgcaggcgctacgtgacagcagcatgagcgcgtacatgtcctccaagaagaccatggagatcaacccggacaacggcatcatggaggagctccggaagcgcgccgaggccgaccggaacgacaagtccgtcaaggacctcgtgctgctgctcttcgagacggcgctgctcacctcggggttcagcctcgacgaccccaacacgttcgcggccaggatccacaggatgctcaagctcggcctcaacatcgacgaggat

SEQ ID NO: 8042 - DNA, 925 bp, Zea mays
gcgcagaaaaaggaagcagcagctttgatcgggtggagtttcttgctcactgatcgtcgagttcctgttcgatcgaagttccaggtgcgcacgtacgcactgaagcctttggggtccgtgacgatgtcgaggagagccgcagcgttgttgctcgcgtgcctcgtcgccgtgacagcggcggcgctggcggacggcgcgctgctcccgtggttcggcggcggccggcgcgggctcgacgaggcagcggtgtccgacgtgggcctcctggcggccgacccgttccggatcctggagcacgtcccgttcggcttcgaccgggacgacgtggccatggtctccatggcgcgcgtggactggcgcgagacccccgacgcgcacgagatcgtggtcgacgtgcccgggatgcgcagggaggacctcaggatcgaggtcgaggacaacagggtgctgcgcgtcagcggcgagcggcggcgcgcggaggagcgcaagggcgaccactggcaccgcgaggagcgctcctacggcaggttctggcgccggttccgcctccccgagaacgccgacctcgactccgtcgccgccagcctcgacagcggcgtcctcaccgtgcgattcaggaagctggcgcccgagcagatcaagggcccgcgcgtcgtcgggatcgccggaggagacggtggcgccgaggcgaaggagagcatcggaactggcgccggagatggtcatcagaccaagaaggtggagctctgaacagtgaggtgggaattgggatgactcaatgacggagatggctctgcgcgtgtgcgtagttttactagtttatgtgttcgcgtttttcttttttgtgacagcgtatatgcacttgtatggagtggaagtgtgccatgttttactgaggaataaaaacctacagtactagtgtact

SEQ ID NO: 8043 - DNA, 1014 bp, Zea mays
caccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcagatattttccgtgatccgcttagtgcgccgcacagcattggccgcctgctgaacctgatggacgacttggcggtggcggcgccaggtcgtgcggtgcgccgtggctggaacgcgaaggaggacgaggaggcgctgcacctgagggtggacatgccgggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggagcctggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagattttt

SEQ ID NO: 8044 - DNA, 1172 bp, Zea mays
ccgcaaccgcaagcaagcgaagcgcagagcctgcctgaccagagctagctgagctacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggaatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttgcagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggcccactgattggcgccgccatcgccgccgcctaccaccagtacgtgctgagggccagcgccaccaagctcgggtcctaccggagcaacgcctaagttccggccggccgcccgcccgaacgcgccaggagctgggcaccgttacaattctgttcctccacatgacgccctgttccgtttccgtgtggccaggactccgcttgcttcctgctgttttctacttcggaccaaagtgtgacgtatcgttgctttctgtatatgtatgtaggaatgcatcatgtaacgagaatttggaatacaattgcgtgagtttttatc

SEQ ID NO: 8045 - DNA, 1291 bp, Zea mays
ggcctgccctgtcctgccttgttaagcaacacagcgagacatcacgagagctagagagagatggcggccacggtttcctccttcccggtggtgaacatggagaagctggagacagaggagagggccacggccatggaggtcatccgcgacggctgcgagaactggggcttcttcgagctgctgaaccacggcatctcgcacgagctgatggacgaggtggagcggctgaccaaggcgcactacgccaccttccgggaggccaagttccaggagttcgcggcccggacgctggaggccggcgagaagggcgccgacgtcaaggacgtggactgggagagcaccttcttcgtccgccacctcccggcctccaacctcgccgacctccccgacgtcgacgaccgctacaggcaggtgatggagcagttcgcatcggagatccggaagctgtcggagaggctgctggacctgctgtgcgagaacctcggcctggagcccgggtacctgaaggcggccttcgccgggtcggacggcccgacgttcggcaccaaggtgagcgcgtacccgccgtgcccgcgcccggacctcgtcgacggcctccgcgcgcacaccgacgccggcggcatcgtgctgctgttccaggacgaccaggtgagcggcctgcagctgctcaggggcggggagtgggtggacgtgccgcccatgcgccacgccatcgtcgccaacgtcggcgaccagctggaggtcatcaccaacgggcggtacaagagcgtcatgcaccgcgtgctcacgcgccccgacggcaaccgcatgtccgtcgcgtccttctacaacccgggcgccgacgccgtcatcttcccggcccccgcgctcgtcggcgccgccgaggaggaccgcgccgaggccgcgtacccgagcttcgtgttcgaggactacatgaacctgtacgtgcgccacaagttcgaggccaaggagcccaggttcgaggccatgaagtcggccatcgccaccgcgtgagcaaagactgacttccgctcccggcttccttcgtggcgtcaagccttgaggcttgaacgaacaacgtacgtccatgtgcttatagtggcacagttatcgcgtggaacggcctaatgtatttcggttgcctcagatcgatctatatgtgcgtatacattatgtactgaaaagtgtgtagcgtctggttaatgtacgagcagtgtgtatgtgaccaggacccggtgtgtagttgctactactaccatatccggtgaatgatcaaaccttttggtgtatt

SEQ ID NO: 8046 - DNA, 1077 bp, Zea mays
tcagcagagctttcccgtgaggaaaatgtgtacatggtgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 8047 - DNA, 1243 bp, Zea mays
tttcctcccttcccatcccccactgctcagcagtcagtcagcactcgccacccacacgcctccgctccgcccacgggtccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagtatatgcattctgtgtaatctatgcatcggattgcagctgg

SEQ ID NO: 8048 - DNA, 2019 bp, Zea mays
ctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatatgaggcccgtctggaagatggtactgttgtatccaagtctgagggggttgagtttactgtgaaagatggctacttttgtcctgccctggccaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaacgagggtgctgttgttgaagtcaaaattatcggaaagcttcaggatggcgcggtgtttacaaagaaggggcatgacgaagagccatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggctgctggtaagaagaaagaggaagggaatgcattgttcaaatcgggcaaatatgctagagcttccaagcgatatgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaactagacagccaaaatgtcaaggctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtagcttttggggtggaggatgttgtggtgaagcgaagggattaaaaacaccgatttctgctgccgaaggacttcgcccgttgcttaacttctcgcttttcgcatactttgtagtcaattagtgtgcacggatgcttggatatgtgaaactgaggaacatgtacttcgaggattattattggttctgaatttttatgttttctggttcttgttaggaccgttgaatgttctctctatataattttcggacacatgttcttaat

SEQ ID NO: 8049 - DNA, 2505 bp, Zea mays
cgaaaccaagcaacaattgagcgatcgatccatcgcctctctctctctcagcaatctatccgcgacaactaagcattcgattctccgacaacaacaagcagggcaatggcgtctgcggacgtgcacatggctggcggtgcggagacggagaccttcgcattccaggccgagatcaaccagctgctctccctcatcatcaacaccttctactcgaacaaggagatcttcctcagagagctcatctccaacgcatcggatgcgcttgacaagatccgcttcgagagcctgacggacaagtcgaagctggacgcgcagccggagctcttcatccggctcgtcccggacaaggccagcaagacgctgtccatcatcgactccggcgtgggcatgaccaagtccgaccttgtcaacaacctcggcaccatcgcgcggtcgggcaccaaggagttcatggaggcgcttgccgcgggcgccaccgacgtgtcgatgatcggccagttcggcgtcggcttctactccgcctacctcgtcgcggacagggtcatggtcaccaccaagcacaacgacgacgagcagtacgtgtgggagtcccaggccggcgggtccttcactgtcacgcatgacaccacgggggagcagctcggtcggggcaccaagatcacgctcttcctcaaggacgaccagctcgagtacctggaggagcgccgccttaaggacctcgtcaagaagcactcggagttcatcagctaccccatctacctgtggacggagaagaccaccgagaaggagatcagcgacgacgaggaggaggaggacaacaagaaggaggaggagggcgacgtcgaggaggtggacgacgaggacaaggacgccaaggataagagcaaaaagaagaagaaggtgaaggaggtgagccacgagtgggtgcagatcaacaagcagaagcccatctggctccgcaagcccgaggagatcacgcgcgacgagtacgcctccttctacaagtctctgaccaacgactgggaggaccacctcgccgtgaagcacttctcggtggaggggcagctggagttcaaggccatcctgttcgtgcctcgccgcgcgcccttcgacctgttcgacacgcgcaagaagctcaacaacatcaagctctacgtccgccgcgtcttcatcatggacaactgcgaggagctcatcccggagtggctgggcttcgtgaagggcgtggtggactcggacgacctgccgctcaacatctcccgcgagacgctgcagcagaacaagatcctcaaggtcatccgcaagaacctggtcaagaagtgcatcgagatgttcttcgagatcgcggagaacaaggacgactacgccaagttctacgacgccttctctaagaacatcaagctgggcatccacgaggactcgcagaaccgcgccaagctcgccgacctcctgcgctaccactccaccaagagcggcgacgagacgacgagcctcaaggactacgtgacgcgcatgaaggaggggcagaaggacatctactacatcaccggcgagagcaggaaggccgtggagaactcgccgttcctggagcgtctcaagaagaagggctacgaggtgctgttcatggtggacgccatcgacgagtacgccgtggggcagctcaaggagtacgacggcaagaagctggtgtcggcaaccaaggaaggcctaaagctggacgacgaggacgacgaggaggccaagaagcggcgggaggagcgcaagaagcggttcgaggagctgtgcaaggtgatcaaggacatcctgggcgaccgcgtcgagaaggtggtggtgtcggaccgcatcgtcgactcgccgtgctgcctggtgacgggcgagtacgggtggaccgccaacatggagcggatcatgaaggcgcaggcgctacgtgacagcagcatgagcgcgtacatgtcctccaagaagaccatggagatcaacccggacaacggcatcatggaggagctccggaagcgcgccgaggccgaccggaacgacaagtccgtcaaggacctcgtgctgctgctcttcgagacggcgctgctcacctcggggttcagcctcgacgaccccaacacgttcgcggccaggatccacaggatgctcaagctcggcctcaacatcgacgaggacgctgctggcgacgaggacgccgacatgcccgcgcttgacgagggcgccgcggaggagagcaagatggaggaggtcgactgaggtgtccttccttcctataatatgcaagttttcagcgatgagggacgacggtcaatggcgatgcctgtttgtgtgtgtctgcgtgtgggtccaaaggggtcactgttggtacaggtcacggtagtgtctagtagtaccttgattgccaggaggcaggaccgtgtgtcttcttcgtgtcacatttcgggtctgctctgagtgtcgtggaatcctgtgaaatacatccgatccgagtccttagcttccctcatc

SEQ ID NO: 8050 - DNA, 834 bp, Zea mays
cagaggtgggttggcttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 8051 - DNA, 1161 bp, Zea mays
cttctctcctcgtccaaagactccaagcttctgtgacctctgttctgctgccgcctctggtccacatctctctacgccgccgccccgccgtccaccgataccgcagcgctgggaaggatcacgggggagcggagcgaggcggggggcccgcggttttgtcgcccggatggcggcgcagcgatgacactggcggcgggagcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatatactgttctataggagctcctggggcagaaatggggttattcagtggtctctctgttattactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtatcgtgtgccattagaaactgtacaaaagattaatagaccgctcatttttctctggtcgcacaagttcaattc

SEQ ID NO: 8052 - DNA, 686 bp, Zea mays
ccaccgctgcctccgcggtttcgcttccccccgtcttcccaagcctttgcttcgctcttcgcttcggattccctctgctcatggccgggagagggaaggcgatcggctcaggggccgccaagaaggccatgtccaggagctccaaggccgggctccagttcccagtgggaaggatcgccaggttcctcaaggccggcaagtacgccgagagggtcggcgccggcgcccccgtctacctcgctgccgtgctcgagtatcttgctgctgaggttctcgagcttgccgggaacgcggctcgggacaacaagaagacccgcatcgtcccgcgccacatccagctcgccgtccgcaacgacgaggagctctcccgcttgctgggcacggtgaccatcgccagcggtggtgtcatgcccaacatccataacctgctgttgcccaagaagtctggcggcggcagtgccaaggctgcggctggtgatgaggactagaccgaccacgcctagcctttcatccggtggtggcacctcttgtggatgctgccgtatcaacttgtgcctgtgtagtacgctctagaaatgccttaggtgttgcgttgtagttcgggatgtgtctccctgtaccactgccaaggattagttctgtatattttgctataaggagtgcatcctttggacgacctgtttatc

SEQ ID NO: 8053 - DNA, 864 bp, Zea mays
ttctcgtttcaccgtgcgccacaagcacacaactagggcgaccgccgccgacctacggccagctgtgcccatgtcttcgtcgggccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctggctgcttcggtgaagggagtagggttgatgtaacaagttaccgttgacgtgacagagtaggcttatcatcgacgtagttggggtcttacttgctgagcatctgcgacggcttgagacttttaggcatgtcttctatctccgaagcactctttcggtctttcctgatcagtgagctagcgctctgaaaacgtagcgatgagctgtcccattttcgactaactatttagtgccagtgaatggcctaattctacaactatcacgatgtgcctatatgttaggggattatggattc

SEQ ID NO: 8054 - DNA, 987 bp, Zea mays
ccaccacaacagcgaaggagaaagcagaccaacctagccacccagggagaaaggccaaaagggaggggagagtgtcgtcatggcttccattgtcgcttccaggagggccgttcctctagttcgcgctctggagaagctcatcgcagcgtcctccgcgcccgggactggctccgccctcaggccggtggcagtcgccggcggcctccgtggctacaacaccggcgctccgctccgacgctacgagggggccgagtcggaagacgatagcgtccgcgagtacgatgggcggcacggcggccgggactacgccgtgcccagcctgttctcaggtaatattttccgtgatccgcttagtgcgccgcacagcattggccgcctgctgaacctgatggacgacttggcggtggcggcgccaggtcgtgcggtgcgccgtggctggaacgcgaaggaggacgaggaggcgctgcacctgagggtggacatgccgggcctggggaaggagcacgtcaaggtgtgggcggagcagaacagcccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggagcctggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctctatgccgtgtttggtttccgcagatttttaaaatatgcatgttcaaacc

SEQ ID NO: 8055 - DNA, 1154 bp, Arabidopsis thaliana
actttgacgacccacttttgcagattctcaaggattcttcaaagtcttagtcttttgtgtttctttccagattcttcaattaatatacgctataatctctcactaaatcaggttctttgattccatcattaaactattcgttagttttcccagtttgattcctatatatctttagatcctataagaagcttcagtcttttactaaacccacaaatcaagcttccaagaattagaggaaaaatattaagtactttattttataggtagaacttttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagctactccttgtggatttgatcaggttgtgagtccacgtgactttgatgcgtatcgtaaacttcctaatggagccagaggatttgatcaagaccgtaggaaaggagttccatggacggaggaagaacacaggtgaacaaagttttcaatctttgtgatccttgtttcactcttctttggtgtcttgagttgcaagttactttgttttcttggtttgctgagaccttgtttaattgttttctgcaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggaggaagttatgtttcttggtcagaatctatcctcggtcttctcttcc

SEQ ID NO: 8056 - DNA, 812 bp, Zea mays
gtgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgctccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaatgtaccgtggttgtgaaccggtcaatgtgatctgaaataaaacattgcgtgccaagtttgtgttacaagtttgatgcactgggaatgccaagcaactaatgtggtaataaacatttcgtc

SEQ ID NO: 8057 - DNA, 1489 bp, Zea mays
gccgggccgaggccatgatcgatgcagggaggaggatgctgccgctgctctggcctaatcactagtataaagcaggcggagacagccggcccctctggcctcgctgctcccccttcctccccgtccccacccacatgccctgcctccgccccgccccgccctgcccaagctgagttcccccaccccccaacaaacaattactagagtagctgcattggcggggaaattaaagcgctagaagctcagcagcaatggcggagcaggcgggcgccggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgacggcgcggtggctcaggtgcaccccggcgccgaccgcccgagctccatctgggcgcacgctatcctcagcacggtcgacagctccgcccgtcgccgccgcaaccggcggcagcaggaggccgccagcgacgtctacgactggaacgaccccgagttctcgctgcgccggcggcgcgtcaccgcgttcctgcggctcctgcacgagctccgggaccgccagctgcagcggctggagtccgctgccggcgtcgccctcgaaggcgaccagctgaccccgttcggccggagcctcttcatcggcgcagctggcggcgagcatggcgtggcgctgggcgactacttcctcggccccagcctcgacgccttggtacagcagctcgccgagaacgatgcggcgcggcacggaacgccgccggccaagaaggaggccgtggaggcaatgccgaccgtggaaatcgccggcggcaacgatggcgacgacgcggccagctgcccggtctgcctggaggactacgcggccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcgggggtgatggtagggcaagctctccgggcaacgccgagctagctgaagctgaagagagtggcaggcggttgccgccatccttgcagtggctcaacagcctgttctcgccgtcggcgcagtcctccggtagcggcggcagcagttcgcatcattgggagaactaagcaatattgccatggttgctgccgcttgaaagcttggcccgttggttggtcccaatgtacataggaaggagcaggagcatgccgggttggtgccatgtaaaaatctggagccttttttcagtttggctcatgttaatggtctctgatatgtatcatggctgtaaaaaagaacagaaatgggcaaatgtatg

SEQ ID NO: 8058 - DNA, 1024 bp, Zea mays
cctccccctaatcgcgaacgagcgtctttctcctccgtccgcgcccgtttgctcatcggttttgcctgccggtgggggaccgcctgcacgagcagcggctagccagacgtacgggcttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgaccaggcaaaggctccaagcaagctatcatctgcattctctggaactcaagataaatgcgcggcctgccagaaaacagtgtatccattggagaagatgactctggaaggcgaatcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgcggctgagccggaagcacccgcgcaatcggcgtagaacgtacaaagattagcagcaacgcaaagagaaatagagccgtacgtgtctatctcctctatatatacgaaccctgcatcagtaagtagtcgtcacaagtatatgttcttattttgtaaccttggcagcttggttcagtctgggattgtaacaagtgcatgttgaattgcttgttatgtattatgaggctttggattcatgacgatgaaatgagtatatgggtgtaaacatttggcttc

SEQ ID NO: 8059 - DNA, 1803 bp, Zea mays
aaggtctcctccctcggtctccctcgggctaggctagctagctaggttaccactctggtacaacatggctggtgatggcatggaggtatctgccagcgggggtggcggcggcaacaagcagccgcagatcagccttttggggctgttcctcgcctgcatggtcgccggcggcgtgcagtacggatgggcgctgcagctctcccttctcaccccctacgtccagacactggggattcctcatgctcttacatcagtcatgtggctctgtggacctattgctggcttacttgtacaaccctgcgtcggcctctatagtgacaaatgcacttctaagcttgggagacggaggccattcatctttacaggatgcatcatcatctgtatatctgtgatagtcatcggtttctcctcagacatcggttacgctctcggtgacacgacggaagactgcaatgtttacacggggaagcggctgcacgcggccttgttcttcgtgatgggattctggctgctggacttttccaacaacacggtgcagggccccgcacgcgcgctgatggcggacctcgcaggcagccacggacccagcacggcgaacgccatcttcgtgtcgtggatggcgatcgggaacatcctgggctactcgtcggggtccaccgacaagtggcacacctggttcccgttcctgcagacgagggcatgctgcgaggcgtgcgccaacctcaaggccgccttcctggtgtcggtggtgttcctgggcctgtccacggtggtgaccatgatcttcgcccgcgaggtgccgctggacccggcggcggcggcgaagcaggacgaggccggggagtcgtcgggcccgttcgccgttttcaagggcatgaagaacatgccccccggcatgccgcaggtgctcatcgtcacgggcctcacctggctctcctggttccccttcatcctcttcgacaccgactggatgggccgcgagatgtaccacggcaggcccgacggcagccccgaggaggtggccaggttccaggagggcgtccggcagggcgccttcggcctgctcctcaactccgtcgtcctcggagccagctccttcctcatcgagcccatgtgccgcaagctcaccgccaaggtcgtgtgggtcatgagcagcttcctcgtctgcgtcgccatggccttggtcaccgtcctcagctcctggtcgctcggcgacatcgggggcaacgtgcaggacgccgccgccgtggataagggcctcaagaccaccgcgctcgccatcttcgtcttcctcggcttcccattcgcggtcctatgcagcgttccgttcgccgtgacggcacagctggcggcggccaagggcggcgggcaggggctgtgcacgggggtcctcaacatctccatcgtggtgccacagatggtcatcgccattggctctgggccgtgggacgagctgttcggcaagggcaacatcccggcgttcggccttgccgccgtcttcgccttcaccgctgccgtcgcagggatcatcatgctgccaaagcagcccaagaccagcttccggtccgtctccatgggaggaggccattgatgatcacaactctaggatgcatggtccactgtggttcacgattcttttacctttgggagttggacggccaggtgtttgttctcaaggccgcttccgaggcctaaaccggtgggtttatttctaggccggatcatgacgaacaatctgtttcgctgggttgtaaaggaaaagttttacacgaacacacaacgtgtcggctatttaacttttgg

SEQ ID NO: 8060 - DNA, 887 bp, Zea mays
ctcgactccgcccagtttttccaccaggcgctgtacctggggggcgtcaccgccgcccccgctcggcccacgctccgcctcatgaagcagaacctcgcgttcctctccagcgtcctcaccgagcaggcccagctgccggccgtgctcgaggtgatgagggcctccgtggaggccttcctgacggtcgtcctcgctggcggcagcgggcgggccttcgcccgcggggaccacgccgccgtggccgcggacttcgcgagcttgaagcgcctgttctgcagtttcggggtcggggaggaggcggtcgagagggagacggtgcgggcggaaggggtgctggcgctcatggccgttccgacggaacagctcatccatgagttgctcggccactatgcttccactccgatgagagcggcgggtgacgagttaccgcagctgccgatgatgccgatgacgcccacggcgagacgctggagccggtccgacgccaacaccgtgctccgcgtgctgtgctaccgagacgatgagcctgccaacagattcttgaagaaaacctttaatctgcccaagaggaggtagccgattacgcagttctatcgccggcccataggatcggattggatctatcattcgcgacccaaagggcctgttcgtttctgttgggtttcacaaaaattatttcggctaatcaaaccttatataaattagacaagcaatctacgtaggaattgttccgagtgttcaattctctggaaccgaacaaggcctaatactttttttgaaagcacgttcttattatacacatgtaacaggaaacaggaaagcacgtagacggtggtgtaggtttggtgaggtgagaaacgggaggtcttgcattcctattgattttt

SEQ ID NO: 8061 - DNA, 1998 bp, Zea mays
ctttgccgggggaaaagaaaacaaccgccccgcccccgcccccgcccctacgagcacgacggcctccggatgagggtcctgccgcgtcttttaccgtcagctggatgtcaaatcacaacgcgccctgtgacatccccaagccggcctccgtcgacgagttcctcgccaagaatggcaagaagaagaagtccttcatgtcgggcctcttccgcaagaaagggaggggcgcggacaagaagctgctctcgcggcgggacatcgtcttcgatttggaaggcagaagcggcgacaggatggacctcttggagacgtccgccgctgtccgcaagagcttctcagatcggcactgcacgacgcggatcgagaacctgacgctgagctgcctggattctcccaggagacccaatgtcgacacccgggagtaccgggtgtttgtaggcacatggaacgtgggagggaagcctcctgacagcagcgttaacctccaagagtttctgcagatcgaaggcttgcccgatatatatgtcttggggtttcaggagatcgtgcctctgaacgcgggcaacgtgctggtcgtggaggacaacgagccggcgggcaagtggatggacctcatctaccaggccctgaacaggccgccgccccaccaggacggccagtcctccggcgacgagctctcgccgccgccgtccacctcctcctcccactaccccagccggccgcaaggtgccgcccgcgaccccagcaacgccgccgccatccccaagacctccagcggcggcatgctctgcgcgcagaagccgccgccgccgctcaagatggtcagcaagtgctaccgcgtcgacaacgcgctggtgaagacgtgcacctgcatgtccgacccgtccaccatgcagctccgggcgcgtgagatgcgcgagttcctctgccgcgtcgaggccgccgccgcctcgccgggccgcggcgccgacgacgacgcgctggcctccatcgaaggcggcgaccagaggggcggcggcggcggcatgaactactgcctcgtcgcgaggaagcagatggtcgggatcttcctgtcagtgtgggtgcgccgggagctagtgcagtacgtcggccacctccgggtcgactgcatcggccggggcatcatgggccgcctcgggaacaagggatgcatcgccatgagcatgacgctgcaccacacgagcatctgcttcgtgtgctgccacctggcgtccggcgagaaggaaggcgacgaggtgcggaggaactccgacgtcgccgagatcctcaagaacgcgcagttcccgcgcatctgcaaggtgcccggccagcgcgtccccgagaagatcattgaccacgaccggatcatctggcttggggatttgaattaccgagtctcgttgagctacgaggaaactaagacgctcctggaggataatgagtgggacatcttattggagaaagatcagctcgcgatggagagacaagccgggagagtgttcaaagggtggaaggagggcaagatctacttcgcccctacatacaagtacaagcagaactccgactcgtatctatgggagaccgccaaatcgaagaagaaacgacgaacgcccgcatggtgtgaccggatactgtggcacggccaaggcatcgagcagctgcagtacatcaggggcgagttcaggctctccgaccacaggccggtctgcagcgtgttcgtgatcgaagccgatgtagatagcgggagcaagatcaggaagggctactcaacgctggacgctaggatccactgcgagtcccccgagatacccaagagacacagcttctacgatgacttctgaaattttggcccgtgatgctagttttgtctataacatagcagcttacaaagatcaggcacgtttgtagcgaaaaggctcaggtttctcaagcctaacacctgtcttaatttgtaccaagcggtatactaactgaaagtcaatggtggttactgcacag

SEQ ID NO: 8062 - DNA, 1508 bp, Zea mays
gcccgccgaaaccctagcccgccccgcctcgccgacggcgatgggcgctgcatgatcggtgcgtccccttggaaccgcctgccttctggcatcgccaagcccgctgccgcggctgccgtcgtcgtagcggcgctcgcgtcctccttcctcgccctcccgcgtcctcgcgccgccccgcccccagcgggatccgggcccctcatgtcgaaggcaaaggtctacaccgacgtcaacgttctgcgtcccaaggagtactgggactacgaggcgctcaccgtccaatggggtgagcaggatgactatgaagttgtcagaaaagttggaagaggtaaatatagtgaggtctttgaaggcatcaatgttaacaattatgagaaatgcatcattaagatccttaagcctgtcaagaaaaagaagatcaaaagggagatcaaaatacttcagaatctctgtggaggtccaaacattgtgaagttgcttgatattgtcagagatcagcattcaaagactcccagtttgatatttgaattcgtcaacaacacagacttcaaagtcttgtaccccacattgacggattatgacatccgctactacatatatgagctactcaaggctctagattactgccattctcaaggcatcatgcatcgagatgtcaagccccataatgtcatgatagatcacgagcttcgcaaacttcggttgatagactggggcttagctgagttttaccatccaggcaaggaatataatgtccgcgttgcatcgaggtatttcaagggacctgaactccttgttgatttacaagactatgattattctttggacatgtggagtcttggttgcatgtttgctggaatgatatttcgcaaggaaccattcttttatggccatgacaaccatgaccaacttgtgaagattgcaaaggtccttggaacagatgggttgaatgcttatttgaacaagtatcacattgagctggaccctcaacttgaagctcttgttggaaggcatagtagaaaaccctggtcaaagttcatgaatgctgataaccaacatctagtatcacctgaggccatagattttctcgataagctcctgcgctatgatcaccaagataggctcactgcacgtgaagctatggcacatccctacttcctccaagtcagagctgtggagaacagtagaacgagaccacaataatcgttgtctacaccctcgaaatgaagttgttgctaatttctggaacatcataggctaaaaccgttcaataagcatctcgctccaggaatctgggccatgactccgtggcagtgaatcagatagtatgggtcgcatcatgtgggcaaccttggcagatgtttttattgttgtctttaatcttgggactactgtagctttaaacctacaggctgtgcttgaatgacatgatattcatatcatatcgtctcctgtggtgggatatgaaattgtatgttatctttaaacataaacatactggttgtatt

SEQ ID NO: 8063 - DNA, 951 bp, Zea mays
tgcgctgcaagcaacaaagttctactctgtccacccgtccatctagctctcaagaaccaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctaatgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgtggcaaccggatcgagttcccggctttctaagctaactcactcttcacgtcagttgctgcaatatactgctagtccttttgcttgcattctatgcaagaggataatggaatgttcattccccattcttcattttttttgcaaataaaaggagggcgatcggtgttccatatttattatgttgatcataacatgacattcagagaac

SEQ ID NO: 8064 - DNA, 1129 bp, Zea mays
gcgcagcgcgcagcgcagcccacctatcaataaccgacgagcgaggcgcgagaaccgacttgccaccggctgctcgccgtctctctctctccctcggggcgcgcgcgcgggagacaggccaaccgatcgtcaggcggccagccatgggcaagcacgggcacggcaagtgccacgacgtggaggcgtgctacccgccgggggcagcgggcggcggcaagtacccgtacatgacggagaacccgcagctgcggtgggccttcatccgcaaggtgtacgtgatcgtgtgcctgcagctgctgctgacggtggccgtcgccgcgacggtgaacctggtgcgcgccatcggggacttcttcctctcccgcaccatgggcgccatgttcgccatcatcggcgtcatcgtcgcccccatcctcgtgatgatcccgatgatcatttaccggaagcggcacccggtgaacctcgcgctcctggcgctcttcaccgtctgcatcagcttcgccgtggggctgagctgcctgacggcgaacgggccagtgatactggaggcggtggtgatcacgatggtggtggtgctggggctcaccttctacaccttctgggcggccaagaggggctacgagttcgagttcctggggccgttcctggtgtccgcctgcctcatcctcatgctcttctccctcctgcggatcatcttcccgctgggcaggacggggaccatggtgtacggctgcatcgccgcgctcgtcttctccggcttcatcatctacgacaccgacaacctcatcagggtctactcctacgacgagtacgtcgccgccgccatcgagctctacctcgacatcatcaacctcttccaggccatcctagcggtgctcgaaggcgtcgactgatagggtcatatatataacacggccggctgaggctcatgggctgtgagcatatatacataggatcatatatatgcaatctatacatgagctaccactaccactaccgagagatgggttccaagcttgctgggcaatctgtaatccatagacgatagatagggtcgaacggcaccgccgtgattgaacattattgctacaacgaaacattgcaaatgcaattcattatcttctcttgc

SEQ ID NO: 8065 - DNA, 1122 bp, Zea mays
cttctgtgacctctgttctgctgccgcctctggtccacatctctctacgccgccgccccgccgtccaccgataccgcagcgctgggaaggatcacgggggagcggagcgaggcgggggacccgcggttttgtcgcccggatggcggcggagcgatgacactggcggcgggtgcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatattctgttctataggagctcctgggggcagaaatggggttattcagtggtctctctgttatcactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtattgtgtgccattagaaactgtacaaaagattaatagaccgctcatttttctctggtcgc

SEQ ID NO: 8066 - DNA, 1866 bp, Zea mays
acacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcaggcgagtgcccccctcctctccgcactagatctcgccgcccgatcgcttcgcctcccatttttgctgatttctgagtgtgtttttccgcgcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctggtcatggtgatgtgtttccctctttgaataacagcggaaaacttgacatcttattggctcagggcaaagagtatgtctttgttgcaaactcagacaacttgggtgctatagtcgacatcaagatcctaaaccatctgatcaataaccagaacgagtactgcatggaggttactccaaagacgctggctgacgttaagggtggcactctcatctcttacgaaggaagagttcagcttttggagattgcccaagtacccgatgagcatgtgaatgaatttaaatcaatcgagaagtttaagatattcaacactaacaacttgtgggtgaaccttaaagctatcaagagactcgtagaggctgaggcacttaagatggaaattattccaaaccccaaggaagttgatggtgtgaaagtccttcaactcgaaaccgcagctggtgcagctattcggttcttcgacaaagcgattggaattaatgttccccgctcaaggtttctcccagtgaaggctacatctgatctgttgcttgtgcagtctgatctttacaccttggttgatggctttgtcatccgcaacccatccagagcgaatccagctaacccttcaattgagcttggacctgagttcaagaaggttgccaatttccttgctcggttcaagtccatccccagcatagttgagcttgacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttgtcatcaccagtttttcccaaggacatgtcacaggaactgccaagcctagtcactcctactgagctctatattttgtaattttcatgtgcattccgattccgctgtgagggtcatgtgagcccgctagagaataattgtaatcttctttgctgcgtctgtacttctgtttttgtgcgccaggacgtatatttttactgaaatgatactccgaagagcacgtatggtgtcttaccgggaggactcattgccgcc

SEQ ID NO: 8067 - DNA, 2026 bp, Zea mays
gcacagtaagaaaagatggcgctgccatccatgagtcttgcggcaaagggtgtgcttcccttctcagcacgtacctcgagtggtgtcacacaaaggccggtgtcagtgaccgcttccttggagcacaaaaccagcgatgccagaaggaagttcctaaaacttgcacttgggaaccttggagttggactgcccaccttgttgggcgctaagaaagctctcgctgatgagcaaggcgtctcgtcctcgaggatgtcttattcgaggttccttgagtatcttgacaaggatagagtgaagaaggttgatttgtttgagaatgggacaattgctattgtggaggccatttctcctgagcttggtaaccgcgtgcaaagagtccgtgtgcagcttcctggtctaagccaggagcttcttcagaagttgagggagaagaacatcgattttgctgctcacagcaaccaggaagactctggttctcttctgttcaaccttattggaaatttggcattcccgcttatccttatcggtggtctgtttttactttcaagaagggcacagggtggcctcggtggacccaatggtcctggctttccccttggttttggtcaatctagggccaagtttcagatggaacccaacactggtgttacatttgatgatgttgctggtgtcgatgaagcgaagcaagacttcatggaagtggttgagttcttgaagaaacccgaaaggttcactgctgttggtgctcgcattcctaagggtgtactgcttgtcggtcctcctgggacgggtaaaactttgcttgccaaggcaattgcaggagaggctggcgtgccatttttctcaatttcaggttctgagtttgtggagatgtttgttggtgttggtgcttccagagttcgtgacctttttaagaaggccaaggagaatgctccttgcatagtgtttgttgatgaaattgatgctgttggaaggcaaagaggtacaggtattggtggtggaaatgatgaaagggaacagactctcaatcaactactaactgagatggatggtttcgagggcaacactggaattattgttattgctgccactaaccgggctgacatcttggattccgctttacttagacctgggcgttttgatagacaggtgtctgtcgacgttcctgatgtacgtggaaggacagagattctaaaagtgcatggtagcaacaagaagtttgattctgatgtttctcttgatgtcatagcaatgagaacacctgggttcagcggagcagacttggcaaaccttctgaatgaagcagccattctggctggaagacggggaaggacagcaatttcttcaaaagagattgatgattctattgacagaattgtagctggtatggaagggaccgtgatgacagacgggaagagcaaaagtcttgttgcttaccatgaagttgggcatgcaatttgcggaactttgacgcctggccatgatcctgtccaaaaggttaccttagttccaaggggtcaagctcgtggtcttacatggtttatcccgatggatgacccaacactcatctccaggcagcaactttttgccagaattgttggcggccttggtggtagagctgctgaggaggtcatatttggagagcctgaggtgaccactggagctgctggtgacttgcagcaaattactggcttagccaagcagatggttgtgacattcggtatgtctgaaattggtccatggtctctgatggagggtggggcgcagagtggggacgtcatcatgagaatgatggcaaggaactccatgtcagagaagctcgcggaggacattgattcggccgtgaagcagttgtcggatgaggcctacgagatcgctttgaggcacattagaaacaacagggaggccattgacaaaatcgttgaggtgctcattgagaaggagacagtgaccggagacgagttccgggcgatcctttctgagtttgccgagatccctgttgagaaccgggttcccccagccacac

SEQ ID NO: 8068 - DNA, 1011 bp, Zea mays
aacaatccagcgagctcgaaaaaagggtacgaatacgaaccccaatccagggccggaggagggcgagcgaactcaaaagcaagccgttccagtccaatccgcctcagtccaaatctaatcgccgggtttaggcagaaggggcgggacgcggcgaggtttaggcggggtttgttttgtcccttccgtgcgattctgctctccgcgcgggaggcaagtactgacggaagcgaaggcgaaggcggaggagggggtccccggcggtggaagtggaacgcgccgatgcgcaagtttcaggactccatcaaggccctccaggccgacatcgatcacgccaatgcgatggcgtcggaattcctgagggactacgacggctcggtcatccagatgcgggtggcgtacagcgccgtcgcgcatttcctcctgcagtggaccgactgcaagctcgccggcgcgctcggcctcctcaaggttatgctatacaaggtgtgcgcggacggctcgtcggcgcttcctgattgggagatggaggccagcatcagggagttctacggcgtcattttcccgtcgctgctgcagcttccgagtggcatcaccgagctggacgacaggaagcagaggaagctctgcctgaagaaattcaggagcagggatgagcagctctcggaggtggacacggagagggagctcgagtgcgggatctgcctcgaggttagccccaaggtcgtgctgcccgactgtgcccacatgctctgcatgcggtgctttgaggattggaacgcgaaatcgaagtcctgccccttctgtcgcgcctgcctggaagaggtgaagccgggcagcctgtggatatacaccgacggcagcgacgtggtggacatggataccttgactagggagaacatcaggcggctgttcatgtacataaataagctgccacttgtagtcctacatgtagttgaccttgacgtttacaagtaccgcatcaagtaaaatgcaactgatccttccttggtg

SEQ ID NO: 8069 - DNA, 1816 bp, Zea mays
gcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaat

SEQ ID NO: 8070 - DNA, 1041 bp, Zea mays
ccgagctcttccacacccgccctctctcttgtgggtcggcggccgagtgtctgcgtcgtccacggagatcagggatcggcggcggggtatggcgagggagcgtcgggagataaagaggatagagagcgcggcggcgcggcaggtcacgttctccaagcgccgccgcggcctcttcaagaaggctgaggagctctccgtgctgtgcgatgccgacgtcgcgctcatcgtcttctcctccacgggaaagctctcccagttcgccagctccagtatgaatgagatcattgacaagtacagcacacattctaaaaacctggggaaagcagaacagccttcacttgacttgaacttagaacatagcaaatatgcaaatttgaatgagcaacttgtggaagcaagccttcgactcaggcagatgagaggtgaagaacttgagggattgagtgttgaagaactccagcaattggagaagaatctggaatctggtctgcatagggtccttcaaacaaaggatcaacaattcttggaacagatcagcgacctcgaacaaaagagtacacaactggcagaggagaacaggcaactgaggaatcaagtatcccacatacccccagttggcaagcaatcagttgctgatgctgaaaatgttatcgctgaagatgggcaatcctctgaatcagtcatgactgcgttgcattctgggagttcacaggataatgatgatggttcggatgtctctctaaaattagggctgccttgtgttgcatggaagtgaaaaaacaagatggtctgtgttgatctgggtggagctgcggcttcagcagataggcacttgtgttattgtcttatggacgacccccgactactgcaataatcttgcatcggaagcgagatcagttaacctgatttgtcatccttgtggcttcatgatgcgatgttgcgcttgtaccgtttgctaggatgttaactggactagaatcgtgtctacttttgtactgctcgtgaatcctatctactttgtgctatccaaagttatgacct

SEQ ID NO: 8071 - DNA, 2259 bp, Zea mays
tagtgttcttggttggtggaatggaagctcagcagctccatttgtgttccagagatcttcgtcgttctcgttcccctcgtgtgtagcctttggtaggttggtggaagggcgaggcacacaagaaaattgatagaggggggatccccattttcagctcttcgtgtttttttgtaggaggaattcccgttcacatgatccgtgcctggacgtgacggttttgccgcgctctgctgcttccctttcggggagaagaggactcgactcaaatcatttggtatcgcagacgtcgcccttcccagttcagttgagagagatttctggcatgtccggcgcaagtaactatggatccctcatcgatgaatggttgccgccccctacacctagcccaagaactctcatgtctagctttctgaatgaagaattcagctctgcgccattctctggtccccatgatcaatctgaaaagagcagagaagttttgaattcgagcgatgaggttccttcacatgctgtcaaaggcctatttcaaaatggtttctcaaatttgttcagtgctaaatcaaactccaatggtggtttggcggagcgcagggctgcgagagcaggtttcagtgtcccgaaaattgatacttctcgagttggttcatccacagttattcgatctcctgtgtcaattccacctggtctaagtccaactacacttcttgagtctcctgtttttctttacaataaaatggcacaaccgtctccaaccactggcacattgccatttttgatggctacgaatgataagtcaacaatatcaccagctgccaagataactgaagattctacatttgataatgatgtgttttctttccaaccccacttaggttctgaacaaacagggttctctactgcagaaaaggactatggtgcctatgagaaaaagcagtccttgtcgaatattcatcagcaggaatccagtcttcagtcaagctttaccgcagtcaaggataacactagtgcaacaattgttaaagcgaagccatcttctagttccatgttcagtgatagtcactattcagctgaccaacagcaagctgacgagacaaacataaaggtgcaaggcaaaggtgtggaggctagatcagctgcttttgctcctgtatcagcgcacagtgatgcatctctcctggagtctcaagaagcacttgatgtctcctcaacactgtctaatgaagaggacgagagggcaacacatggcactgtttctatagagtgtgatggtgatgaagctgagactgtatctaaaagaaggaagctggaactagatgctttagaagctactcttactgctactacctccaccaccagtaccatcgacatggggcctgcagcctcaagagctgtccgggagcctagggttgttgttcagaccacaagtgaggtagacattcttgacgacggttatcggtggcgcaagtatgggcagaaggttgttaagggcaatccaaatccaaggagctactacaaatgtacaaacccgggctgttcagtgcgcaagcatgtggaaagagcatcgcacgatctgaaatcagtcatcacaacgtatgagggaaagcacaaccatgaagttccagcagccagaaatagtgggcaaggcagttccagcgctccatctgcatcacaagctggtggttctcaccgtaggcaagaacctgcacaggccagctttgctcacttcggtacggcttctttcagctcgttcggtctcccaccgagtggtcagttgggaccaacaactggcaatttcggcttcgggatggttcccccaggcatgacgatcccagtgccctctctaggatcgcttgcccctgtaaagatggttggaaattcatcagctatgcaggggtacccagggcttatggtgccgggagaaccaaaggtagagcctgtctcgcaaccactcatccaaatggcaaatgcatctccaccagcttaccaacagatattgagcaggcctcctttcggtcaccagatgtaaataataggaaagagaaaggggataatagatttgcttcagcttgtatacatgatagctacgctgcaacatggctttagtgttcatggatcgtccaattttttatttctattttatttttctgcccacgcatgtctttgaagcaaagaatgctgaggatgataccctgtcgtgcctgttgtaatcacgtaaaggatacctttcgtctttttgagactcgaaattggaaaacgatc

SEQ ID NO: 8072 - DNA, 1340 bp, Zea mays
cagagaggagcttcatcagctcattcaattctcgttccatccctcgtctcttgtgtcccgcctccgttccataattcaccagcgtcgtcctacccatatctcctatcgtcttctccctcgcgccatcagcttccccaagccagcggcgaccatgatctccccggacaccatccgcacggccatcggcgtcatcggcaatgggactgcactcgtgctcttcctctccccagtgcctacgttcatccgcatctggaagaaagggtcggtggagcagtactcgccgatcccgtacgtggcgacgctgctgaactgcatgatgtgggtgctgtacgggctgccggcggtgcacccgcacagcatgctggtgatcaccatcaacggcaccggcatggcgatccagctgacctacgtggcgctcttcctcctctactccgcgggggctgcgcggcgcaaggtggtcctgctgctggccgccgaggtgggcttcgtcggcgccgtcgccgcgctggtgctcagccttgcgcacacgcacgagcgcaggtccatggtggtcggcatcctctgcgtcctcttcggcaccggcatgtacgccgccccgctctccgtcatgaaaatggtgatccagacaaagagcgtggagtacatgcccctgttcctgtcgctggcttccctcgtgaatggcatctgctggactgcttacgcgctcatccgcttcgacctctacattactatccccaacgggctgggcgtgctgttcgcggtggcgcagctggtgctgtacgccatctactacaagtccacccaggagatcatcgaggcgcgcaagcgcaaggccgaccagatcgccatgaccggggtggtcgtcgacggcggcaagaccaacaaccaagccggcgcgggccaatactgaccgacgatcaagtgacgatcgacaccaatatgctcaagcaagaagccagcggcaaatcaattatgtcgccgctgggttttatgtattttgtgattctatatgcacgctagctgcttgtccgtcccggccaatggaaaaaaaagggggaagaaaaaatgtctgtcggtatatgtgttctcgccgaataactctcgcgcatagctagctggtggggctgagtcactgccttcgctatatgtatacgtgcaaaaattagaggtggagggttgttttagctaatcccaccttaattccaaggcacagtgacctttttttttctccttctgtttcggctaggattttgctataattgagcaatttagcgcgacttgttattggtgttggtgtgtctcaatcaaatagtaaaatgttcattttactctttcaaaaa

SEQ ID NO: 8073 - DNA, 985 bp, Zea mays
gtgctgtgctctgctctgctctcgcctcgcacggactcgtggtaaaggatggagaccatgtcggctctcgcgaggacggcgccgccccttgctgggaccattcgccggccctcatgcgcgctgaggccgacggcgtccctctccttcgccgccgcttcaacgacgccccgcggccggctcgggctggggctgagcacggcgccggcggggagcgggagggcggccagggctcgcgccgtcccgcggcgcatcgtcgcctcctcggaggttgagcaaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggccctgttgtctgcatggcctgggagggtgatggtgttgttgcatcagctcggaaattaataggagctactaacccccttcaagctgaaccagggactataaggggtgatcttgcagttcaaactggaaggaacgttgtccatggaagtgatagtcctgataatggcaagcgtgaaattgaactgtggttcaaagaaggcgaggtctgccaatgggaatcagttcaagcaccgtggcttatagaataactattgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagctaatttcttgtcatatttacatgtaataaagtccctctactacagtaataaattagtatttcctctggtccaatt

SEQ ID NO: 8074 - DNA, 1616 bp, Zea mays
aagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgagg

SEQ ID NO: 8075 - DNA, 822 bp, Zea mays
tggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgc

SEQ ID NO: 8076 - DNA, 1441 bp, Zea mays
aaaagattcgcggcggtggagtcggagctcaactcatcaatagggtttgatcagcgctccgctcgtgctagccacccagcccccccgcgcccacttgcgacggcgatggcttcgccgtactcgctcagctgggccgacgcgccgccctaccactaccacgggagaccccagccagcgcccgactcacccgcatcctccgacggggccgggccccgctcgctctggatcggcggcctgctgccatggatggacgaggactacctctacggctgcttcaccacctcgcgcgagcttctttcccttgtcatcaaacggaacaagcagactggccaatcagagggctttggcttcctcaaattttctgaccataccgccgctgctcatattctcaagtcttacaatggtcagaagatgcctaacgctgttcaagatttcaagctcaactgggccacccaacaacctgctcccaagaaacttcctgatccagatttcaagctcgacctggccacgcagcaggagaggcatgccgccgttgattcctcatctgatcattccatattcgttggggacttggcctacaatgttacaggatacatgctacaccatgtgttcaaggcccgctacccatcagtgaagagcgcaaaaatcatctttgacaagttcactggcctctcaaaatgctatggatttgttcagtttggagatgtcgatgagcagatacaagcactgacagaaatgaatggagcctactgttctaccaggcctatgcggattggacctgttcccaagaagaaaaattctttccgcagcaaacagtggactgagtcttatcacgatgcaaacaattcaaggctatttgttgggcaacttgaccaaagtgtgacttctgaagatctgatgcaagcctttagtccatatggggagcttgttgatgtgaaggcattaccagggaagggctgtgggtttgtcacgtactctaacagggcatcagcagaggaagccattagaatgctgaatggaagtcagctggaggtaaagccataaaactttcgtggggttacccttctgctgacaagcaggctcaaaggaacagcggcggcgggttcggacgcgactgcttcgtttggtctcctcagtatccctacgcttacgctcagacatgccaaccgggatatggatattaattaccgatagcaagctgcccacagtgcagtgagatcgtgtgaagaaagatgtcagtcacaaggaacagctgctagggtgtagagggatttttggtccatgtttttttttctttttggaaattggttcctcctatggttgcataccgtgaagcatcggcatctggatccatacatgagaatgcaaacaacgattgaatgtacatttacacacatactgctactactatattaattactgtaccttgaattttttgtct

SEQ ID NO: 8077 - DNA, 1606 bp, Zea mays
gtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctat

SEQ ID NO: 8078 - DNA, 1863 bp, Arabidopsis thaliana
caaaaaacgaaaacgatgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgcgggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttggctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtagtaatgctgttatctatctactttcattacatacaaaagtttgtttctttcaactgtaactgtctctgtatcaataacaacattgctgtgt

SEQ ID NO: 8079 - DNA, 1884 bp, Arabidopsis thaliana
gaaaacacagagagagagagattcacttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggaccaggtgatcttatgttgttttggtcatatatttacacagttaggattttatttccctttggattttggataatctatgagacaatttttaaggt

SEQ ID NO: 8080 - DNA, 1917 bp, Arabidopsis thaliana
gataggtagcttcaacgtaaggaatctaaattggttcagctcaaaaaacgaaaacgatgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgcgggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttggctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtagtaatgctgttatctatctactttcattacatacaaaagtttgtttctttcaactgtaactgtctctgtatcaataacaacattgctgtgtacttttcctttca

SEQ ID NO: 8081 - DNA, 715 bp, Arabidopsis thaliana
gagaaatttctcagttacgcttcatcctcctctaagagatcttttttctatcttgggtagtagagagaaatggcgggtcggggaaaacaacttggatctggtgcagcgaagaagtctacttctcgtagtagcaaggctgggcttcaattccctgttggtcgtatcgctcgatttttgaaagccggtaagtacgccgagcgtgttggtgccggagctccggtctatctcgccgccgttcttgaatacctcgccgctgaggtacttgagcttgctgggaacgcagcgagagacaacaagaagacccgtatagttccacgacacattcagcttgctgtgaggaatgatgaggagctaagcaagttgcttggagatgtgacaattgctaatggaggagtgatgcctaacatccacaatctccttctccccaagaaggctggttcatctaagcctactgaagaagattaggttcattacgaagatagggaaagctggaaactggttgatatcagataatgcttaggattgttttttttttcatttgcttttcctctgcagcaatggaagctgtgtggttgtactagttgttaaggttacctttgtttcactttatgtgaatatatgaagaaattgttctatttcagtcttgactccacttctttagcattgttcactgattcatttgttgttcctgaaagtcaatttaaattccttcgat

SEQ ID NO: 8082 - DNA, 2088 bp, Arabidopsis thaliana
agctctcaaacaaaacagccttttacataagaacaaacacccccaaaaactgcaaaaaaaagagagagatcattaatccatcttcaagatgtctcttcctgaaactaaatctgatgatatccttcttgatgcttgggacttccaaggccgtcccgccgatcgctcaaaaaccggcggctgggccagcgccgccatgattctttgtattgaggccgtggagaggctgacgacgttaggtatcggagttaatctggtgacgtatttgacgggaactatgcatttaggcaatgcaactgcggctaacaccgttaccaatttcctcggaacttctttcatgctctgtctcctcggtggcttcatcgccgatacctttctcggcaggtacctaacgattgctatattcgccgcaatccaagccacgggtgtttcaatcttaactctatcaacaatcataccgggacttcgaccaccaagatgcaatccaacaacgtcgtctcactgcgaacaagcaagtggaatacaactgacggtcctatacttagccttatacctcaccgctctaggaacgggaggcgtgaaggctagtgtctcgggtttcgggtcggaccaattcgatgagaccgaaccaaaagaacgatcgaaaatgacatatttcttcaaccgtttcttcttttgtatcaacgttggctctcttttagctgtgacggtccttgtctacgtacaagacgatgttggacgcaaatggggctatggaatttgcgcgtttgcgatcgtgcttgcactcagcgttttcttggccggaacaaaccgctaccgtttcaagaagttgatcggtagcccgatgacgcaggttgctgcggttatcgtggcggcgtggaggaataggaagctcgagctgccggcagatccgtcctatctctacgatgtggatgatattattgcggcggaaggttcgatgaagggtaaacaaaagctgccacacactgaacaattccgttcattagataaggcagcaataagggatcaggaagcgggagttacctcgaatgtattcaacaagtggacactctcaacactaacagatgttgaggaagtgaaacaaatcgtgcgaatgttaccaatttgggcaacatgcatcctcttctggaccgtccacgctcaattaacgacattatcagtcgcacaatccgagacattggaccgttccatcgggagcttcgagatccctccagcatcgatggcagtcttctacgtcggtggcctcctcctaaccaccgccgtctatgaccgcgtcgtcattcgtctatgcaaaaagctattcaactacccccatggtctaagaccgcttcaacggatcggtttggggcttttcttcggatcaatggctatggctgtggctgctttggtcgagctcaaacgtcttagaactgcacacgctcatggtccaacagtcaaaacgcttcctctagggttttatctactcatcccacaatatcttattgtcggtatcggcgaagcgttaatctacacaggacagttagatttcttcttgagagagtgccctaaaggtatgaaagggatgagcacgggtctattgttgagcacattggcattaggctttttcttcagctcggttctcgtgacaatcgtcgagaaattcaccgggaaagctcatccatggattgccgatgatctcaacaagggccgtctttacaatttctactggcttgtggccgtacttgttgccttgaacttcctcattttcctagttttctccaagtggtacgtttacaaggaaaaaagactagctgaggtggggattgagttggatgatgagccgagtattccaatgggtcattgatcatgaattcatgatcatgatcatgatgatgaacattatgcatgtctatgttgatatgtttgaatttgattttgagttttgtttgtatattttatgatgcttttcttaattacctcttgtttccgagtcgacaaataatggaccgaccgataagggataaaagttaaagttttcccatcaggttctgtataaaagcagaaattgtaacatttcttaagatttgacgc

SEQ ID NO: 8083 - DNA, 1928 bp, Arabidopsis thaliana
cttcaacgtaaggaatctaaattggttcagctcaaaaaacgaaaacgatgggttccatcgaagaagaagcaagacctctcatcgaagaaggtttaattttacaggaagtgaaattgtatgctgaagatggttcagtggactttaatggaaacccaccattgaaggagaaaacaggaaactggaaagcttgtccttttattcttggtaatgaatgttgtgagaggctagcttactatggtattgctgggaatttaatcacttacctcaccactaagcttcaccaaggaaatgtttctgctgctacaaacgttaccacatggcaagggacttgttatctcactcctctcattggagctgttctggctgatgcttactggggacgttactggaccatcgcttgtttctccgggatttatttcatcgggatgtctgcgttaactctttcagcttcagttccggcattgaagccagcggaatgtattggtgacttttgtccatctgcaacgccagctcagtatgcgatgttctttggtgggctttacctgatcgctcttggaactggaggtatcaaaccgtgtgtctcatccttcggtgccgatcagtttgatgacacggactctcgggaacgagttagaaaagcttcgttctttaactggttttacttctccatcaatattggagcacttgtgtcatctagtcttctagtttggattcaagagaatcgcgggtggggtttagggtttgggataccaacagtgttcatgggactagccattgcaagtttcttctttggcacacctctttataggtttcagaaacctggaggaagccctataactcggatttcccaagtcgtggttgcttcgttccggaaatcgtctgtcaaagtccctgaagacgccacacttctgtatgaaactcaagacaagaactctgctattgctggaagtagaaaaatcgagcataccgatgattgccagtatcttgacaaagccgctgttatctcagaagaagaatcgaaatccggagattattccaactcgtggagactatgcacggttacgcaagtcgaagaactcaagattctgatccgaatgttcccaatctgggcttctggtatcattttctcagctgtatacgcacaaatgtccacaatgtttgttcaacaaggccgagccatgaactgcaaaattggatcattccagcttcctcctgcagcactcgggacattcgacacagcaagcgtcatcatctgggtgccgctctacgaccggttcatcgttcccttagcaagaaagttcacaggagtagacaaaggattcactgagatacaaagaatgggaattggtctgtttgtctctgttctctgtatggcagctgcagctatcgtcgaaatcatccgtctccatatggccaacgatcttggattagtcgagtcaggagccccagttcccatatccgtcttgtggcagattccacagtacttcattctcggtgcagccgaagtattctacttcatcggtcagctcgagttcttctacgaccaatctccagatgcaatgagaagcttgtgcagtgccttggctcttttgaccaatgcacttggtaactacttgagctcgttgatcctcacgctcgtgacttattttacaacaagaaatgggcaagaaggttggatttcggataatctcaattcaggtcatctcgattacttcttctggctcttggctggtcttagccttgtgaacatggcggtttacttcttctctgctgctaggtataagcaaaagaaagcttcgtcgtagtaatgctgttatctatctactttcattacatacaaaagtttgtttctttcaactgtaactgtctctgtatcaataacaacattgctgtgtacttttcctttcaatttcaaaagtttaagtcgc

SEQ ID NO: 8084 - DNA, 527 bp, Arabidopsis thaliana
tgatgatttaagtcttgcgatcaagaaaactcaaatcttaaaactttctggcaaaaacaaaaatgtcaggcaagaggaaaaggtaggaaaagggttaggcaaaggaggagcaaagagacacagaaaggttctaagagacaacattcaaggaatcacaaagccagcgattcgtcgtcttgctcgtagaggaggtgtgaagagaatcagtggattgatctatgaagaaacgagaggtgtgttgaagatttttctggagaatgtgattagagatgctgttacttacactgagcatgcgaggaggaagacggtgactgctatggatgttgtttatgccttgaagagacaaggaagaactctatatggatttggtggttgatcaatttgagatctgggttttctggtgaatgatgatgatttaagtcttgcgatcaagaaattccagaaattgggttgaattttagggtttcgttttgtgttgtaattagggcagcattgtaatggattaatgataagtaccatttgctcta

SEQ ID NO: 8085 - DNA, 1061 bp, Arabidopsis thaliana
ctaaaccaaagaaaacccttatttgcgatccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaac

SEQ ID NO: 8086 - DNA, 1268 bp, Arabidopsis thaliana
ctctctcacccaatttgtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgcgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaattttttttttttgtcaagttgtgtaggttgtgattcatgcctaggttgtatttaggaaaagagataagaccaacc

SEQ ID NO: 8087 - DNA, 1768 bp, Arabidopsis thaliana
agaactccagcatatcgagcaggtcttcactcctttggttgagaaatgcaaaaagtacgggagagcaatgcgtattgggacaaatcatggaagtctttctgaccgtatcatgagctattacggggattctccccgaggaatggttgaatctgcgtttgagtttgcaagaatatgtcggaaattagactatcacaactttgttttctcaatgaaagcgagcaacccagtgatcatggtccaggcgtaccgtttacttgtggctgagatgtatgttcatggatgggattatcctttgcatttgggagttactgaggcaggagaaggcgaagatggacggatgaaatctgcgattggaattgggacgcttcttcaggacgggctcggtgacacaataagagtttcactgacggagccaccagaagaggagatagatccctgcaggcgattggctaacctcgggacaaaagctgccaaacttcaacaaggcgttgcaccgtttgaagaaaagcataggcattactttgattttcagcgtcggacgggtgatctacctgtacaaaaagagggagaagaggttgattacagaaatgtccttcaccgtgatggttctgttctgatgtcgatttctctggatcaactaaaggcacctgaactcctctacagatcactcgctacaaagcttgtcgtgggtatgccattcaaggatctggcaactgttgattcaatcttattaagagagctaccgcctgtagatgatcaagtggctcgtttggctctaaaacggttgattgatgtcagtatgggagttatagcacctttatcagagcaactaacaaagccattgcccaatgccatggttcttgtcaacctcaaggaactatctggtggcgcttacaagcttctccctgaaggtacacgcttggttgtctctctacgaggcgatgagccttacgaggagcttgaaatactcaaaaacattgatgctactatgattctccatgatgtacctttcactgaagacaaagttagcagagtacatgcagctcggaggctattcgagttcttatccgagaattcagttaactttcctgttattcatcacataaacttcccaaccggaatccacagagacgaattggtgattcatgcagggacatatgctggaggccttcttgtggatggactaggtgatggcgtaatgctcgaagcacctgaccaagattttgattttcttaggaatacttccttcaacttattacaaggatgcagaatgcgtaacactaagacggaatatgtatcgtgcccgtcttgtggaagaacgcttttcgacttgcaagaaatcagcgccgagatccgagaaaagacttcccatttacctggcgtttcgatcgcaatcatgggatgcattgtgaatggaccaggagaaatggcagatgctgatttcggatatgtaggtggttctcccggaaaaatcgacctttatgtcggaaagacggtggtgaagcgtgggatagctatgacggaggcaacagatgctctgatcggtctgatcaaagaacatggtcgttgggtcgacccgcccgtggctgatgagtagatttcaaaacggagaaagatgggtgggccattctttgaaaactgtgagagaagatatatatatttgtgtgtgtatatcatctgtttgttgtgtattgcatcatcattttgaacaaatgtccaaatctcttaagttgataaaagttcttaggccaaataaaatttaatatga

SEQ ID NO: 8088 - DNA, 1768 bp, Arabidopsis thaliana; identical to SEQ ID NO: 8087

SEQ ID NO: 8089 - DNA, 1593 bp, Arabidopsis thaliana
caactagatctctcttctcctctgctcgttcaatgttataacgatctcgagtatcacaaaagaacaagatgtctattcgaagaatctaccgatgtctgaattctttaatcaaaagatcttgtgctcaatctctatgatcatacgccccatttcacactttgtttcacctctcagtttttttttttgtgtttttttgtccctctttgtttcacttgagaacaaccccctttgaactcgatcaagaaagctaagtttgaagaatcaagaatggtgcggacaccgtgttgcaaagctgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatgatggtgatgatgaccatgcatgaatcatgaatgtagttcgtgttgtcacatatgcttgtgtttttgtgttttttttttttggtctgaagtgtgttgtttcgttgtaaatggattataaatggtgatgtaataattataatgttaacgagttgttaactttagtactttt

SEQ ID NO: 8090 - DNA, 2448 bp, Arabidopsis thaliana
aaagtacctccaatggcttcttctgcatttgcttttccttcttacataataaccaaaggaggactttcaactgattcttgtaaatcaacttctttgtcttcttctagatctttggttacagatcttccatcaccatgtctgaaacccaacaacaattcccattcaaacagaagagcaaaagtgtgtgcttcacttgcagagaagggtgaatattattcaaacagaccaccaactccattacttgacactattaactacccaatccacatgaaaaatctttctgtcaaggaactgaaacaactttctgatgagctgagatcagacgtgatctttaatgtgtcgaaaaccggtggacatttggggtcaagtcttggtgttgtggagcttactgtggctcttcattacattttcaatactccacaagacaagattctttgggatgttggtcatcagtcttatcctcataagattcttactgggagaagaggaaagatgcctacaatgaggcaaaccaatggtctctctggtttcaccaaacgaggagagagtgaacatgattgctttggtactggacacagctcaaccacaatatctgctggtttaggaatggcggtaggaagggatttgaaggggaagaacaacaatgtggttgctgtgattggtgatggtgcgatgacggcaggacaggcttatgaagccatgaacaacgccggatatctagactctgatatgattgtgattcttaatgacaacaagcaagtctcattacctacagctactttggatggaccaagtccacctgttggtgcattgagcagtgctcttagtcggttacagtctaacccggctctcagagagttgagagaagtcgcaaagggtatgacaaagcaaataggcggaccaatgcatcagttggcggctaaggtagatgagtatgctcgaggaatgataagcgggactggatcgtcactgtttgaagaactcggtctttactatattggtccagttgatgggcacaacatagatgatttggtagccattcttaaagaagttaagagtaccagaaccacaggacctgtacttattcatgtggtgacggagaaaggtcgtggttatccttacgcggagagagctgatgacaaataccatggtgttgtgaaatttgatccagcaacgggtagacagttcaaaactactaataagactcaatcttacacaacttactttgcggaggcattagtcgcagaagcagaggtagacaaagatgtggttgcgattcatgcagccatgggaggtggaaccgggttaaatctctttcaacgtcgcttcccaacaagatgtttcgatgtaggaatagcggaacaacacgcagttacttttgctgcgggtttagcctgtgaaggccttaaacccttctgtgcaatctattcgtctttcatgcagcgtgcttatgaccaggttgtccatgatgttgatttgcaaaaattaccggtgagatttgcaatggatagagctggactcgttggagctgatggtccgacacattgtggagctttcgatgtgacatttatggcttgtcttcctaacatgatagtgatggctccatcagatgaagcagatctctttaacatggttgcaactgctgttgcgattgatgatcgtccttcttgtttccgttaccctagaggtaacggtattggagttgcattacctcccggaaacaaaggtgttccaattgagattgggaaaggtagaattttaaaggaaggagagagagttgcgttgttgggttatggctcagcagttcagagctgtttaggagcggctgtaatgctcgaagaacgcggattaaacgtaactgtagcggatgcacggttttgcaagccattggaccgtgctctcattcgcagcttagctaagtcgcacgaggttctgatcacggttgaagaaggttccattggaggttttggctcgcacgttgttcagtttcttgctctcgatggtcttcttgatggcaaactcaagtggagaccaatggtactgcctgatcgatacattgatcacggtgcaccagctgatcaactagctgaagctggactcatgccatctcacatcgcagcaaccgcacttaacttaatcggtgcaccaagggaagctctgttttgagagtaagaatctgttggctaaaacatatgtatacaaacactctaaatgcaacccaaggtttcttctaagtactgatcagaattcccgccgagaagtcctttggcaacagctatatatatttactaagattgtgaagagaaaggcaaaggcaaaggttgtgcaaagattagtattatgataaaactggtatttgttttgtaattttgtttaggattgtgatggagatcgtgttgtacaataatctaacatcttgtaaaaatcaattacatctctttgtgtatc

SEQ ID NO: 8091 - DNA, 2191 bp, Arabidopsis thaliana
caaaccaaggctctgatttagctgagcttcaacctgcatccgaaggaagccctctcttagtgccaagacagaaatattgtgaatcattgcataagacggtgagaaggaagactcgtactgttatggttggaaatgtcgcccttggaagcgaacatccgataaggattcaaacgatgactacttcggatacaaaagatattactggaactgttgatgaggttatgagaatagcggataaaggagctgatattgtaaggataactgttcaagggaagaaagaggcggatgcgtgctttgaaataaaagataaactcgttcagcttaattacaatataccgctggttgcagatattcattttgcccctactgtagccttacgagtcgctgaatgctttgacaagatccgtgtcaacccaggaaattttgcggacaggcgggcccagtttgagacgatagattatacagaagatgaatatcagaaagaactccagcatatcgagcaggtcttcactcctttggttgagaaatgcaaaaagtacgggagagcaatgcgtattgggacaaatcatggaagtctttctgaccgtatcatgagctattacggggattctccccgaggaatggttgaatctgcgtttgagtttgcaagaatatgtcggaaattagactatcacaactttgttttctcaatgaaagcgagcaacccagtgatcatggtccaggcgtaccgtttacttgtggctgagatgtatgttcatggatgggattatcctttgcatttgggagttactgaggcaggagaaggcgaagatggacggatgaaatctgcgattggaattgggacgcttcttcaggacgggctcggtgacacaataagagtttcactgacggagccaccagaagaggagatagatccctgcaggcgattggctaacctcgggacaaaagctgccaaacttcaacaaggcgttgcaccgtttgaagaaaagcataggcattactttgattttcagcgtcggacgggtgatctacctgtacaaaaagagggagaagaggttgattacagaaatgtccttcaccgtgatggttctgttctgatgtcgatttctctggatcaactaaaggcacctgaactcctctacagatcactcgctacaaagcttgtcgtgggtatgccattcaaggatctggcaactgttgattcaatcttattaagagagctaccgcctgtagatgatcaagtggctcgtttggctctaaaacggttgattgatgtcagtatgggagttatagcacctttatcagagcaactaacaaagccattgcccaatgccatggttcttgtcaacctcaaggaactatctggtggcgcttacaagcttctccctgaaggtacacgcttggttgtctctctacgaggcgatgagccttacgaggagcttgaaatactcaaaaacattgatgctactatgattctccatgatgtacctttcactgaagacaaagttagcagagtacatgcagctcggaggctattcgagttcttatccgagaattcagttaactttcctgttattcatcacataaacttcccaaccggaatccacagagacgaattggtgattcatgcagggacatatgctggaggccttcttgtggatggactaggtgatggcgtaatgctcgaagcacctgaccaagattttgattttcttaggaatacttccttcaacttattacaaggatgcagaatgcgtaacactaagacggaatatgtatcgtgcccgtcttgtggaagaacgcttttcgacttgcaagaaatcagcgccgagatccgagaaaagacttcccatttacctggcgtttcgatcgcaatcatgggatgcattgtgaatggaccaggagaaatggcagatgctgatttcggatatgtaggtggttctcccggaaaaatcgacctttatgtcggaaagacggtggtgaagcgtgggatagctatgacggaggcaacagatgctctgatcggtctgatcaaagaacatggtcgttgggtcgacccgcccgtggctgatgagtagatttcaaaacggagaaagatgggtgggccattctttgaaaactgtgagagaagatatatatatttgtgtgtgtatatcatctgtttgttgtgtattgcatcatcattttgaac

SEQ ID NO: 8092 - DNA, 1111 bp, Arabidopsis thaliana
aacaaagcaacaagcaagattcatcaaatccttatcttctctctttcactcacaaccaattgctcatcccacctacttgttccccacaaaacactctctccctctttgttctttcatcttctctaagctctttctctgaacctacgcttctgctaagctattctaagagaagccagactagcaataaacccttcattttaagcattctgtttccttcttgagaaacctagatattttggtttcttgtatccggtgatgaagatacagtgtgatgtgtgtgagaaagctccggcgacggtgatttgttgcgccgacgaagctgctctctgtcctcaatgcgacatcgagattcacgccgctaacaaactcgctagcaagcaccaacgtcttcatcttaattccctctccaccaaattccctcgttgcgatatctgccaagagaaggcagctttcattttctgtgtagaggatagagctctgctttgcagggactgcgatgaatccatccacgtggctaattctcgatctgctaatcaccagaggttcttagccactgggatcaaagtagctctgacctcaactatatgtagtaaagaaattgagaagaatcaacctgagccttccaacaaccaacagaaggctaatcagattcctgctaaatccacaagccagcagcaacaacaaccttcttctgctactccacttccctgggctgttgacgatttctttcacttctctgatattgaatccaccgacaagaaaggacagcttgatcttggggcaggggagttggattggttttcagacatgggattcttcggtgatcagattaatgacaaggctcttcctgcagctgaagttcctgagctttctgtttcgcatttaggtcatgttcattcatacaaacctatgaagtcaaatgtttcacacaagaagccgaggtttgagaccagatatgatgatgatgatgaggaacacttcattgtccctgatcttggctaaaaagctatatgtaatctatgtgtagacattcttcaatgtaaaagaacaaacaagaaacctatctgcatgtgtggagttaatgtcatatacattttagttttgtcttaaa

SEQ ID NO: 8093 - DNA, 1705 bp, Arabidopsis thaliana
gcgtattgggacaaatcatggaagtctttctgaccgtatcatgagctattacggggattctccccgaggaatggttgaatctgcgtttgagtttgcaagaatatgtcggaaattagactatcacaactttgttttctcaatgaaagcgagcaacccagtgatcatggtccaggcgtaccgtttacttgtggctgagatgtatgttcatggatgggattatcctttgcatttgggagttactgaggcaggagaaggcgaagatggacggatgaaatctgcgattggaattgggacgcttcttcaggacgggctcggtgacacaataagagtttcactgacggagccaccagaagaggagatagatccctgcaggcgattggctaacctcgggacaaaagctgccaaacttcaacaaggcgttgcaccgtttgaagaaaagcataggcattactttgattttcagcgtcggacgggtgatctacctgtacaaaaagagggagaagaggttgattacagaaatgtccttcaccgtgatggttctgttctgatgtcgatttctctggatcaactaaaggcacctgaactcctctacagatcactcgctacaaagcttgtcgtgggtatgccattcaaggatctggcaactgttgattcaatcttattaagagagctaccgcctgtagatgatcaagtggctcgtttggctctaaaacggttgattgatgtcagtatgggagttatagcacctttatcagagcaactaacaaagccattgcccaatgccatggttcttgtcaacctcaaggaactatctggtggcgcttacaagcttctccctgaaggtacacgcttggttgtctctctacgaggcgatgagccttacgaggagcttgaaatactcaaaaacattgatgctactatgattctccatgatgtacctttcactgaagacaaagttagcagagtacatgcagctcggaggctattcgagttcttatccgagaattcagttaactttcctgttattcatcacataaacttcccaaccggaatccacagagacgaattggtgattcatgcagggacatatgctggaggccttcttgtggatggactaggtgatggcgtaatgctcgaagcacctgaccaagattttgattttcttaggaatacttccttcaacttattacaaggatgcagaatgcgtaacactaagacggaatatgtatcgtgcccgtcttgtggaagaacgcttttcgacttgcaagaaatcagcgccgagatccgagaaaagacttcccatttacctggcgtttcgatcgcaatcatgggatgcattgtgaatggaccaggagaaatggcagatgctgatttcggatatgtaggtggttctcccggaaaaatcgacctttatgtcggaaagacggtggtgaagcgtgggatagctatgacggaggcaacagatgctctgatcggtctgatcaaagaacatggtcgttgggtcgacccgcccgtggctgatgagtagatttcaaaacggagaaagatgggtgggccattctttgaaaactgtgagagaagatatatatatttgtgtgtgtatatcatctgtttgttgtgtattgcatcatcattttgaacaaatgtccaaatctcttaagttgataaaagttcttaggccaaataaaatttaatatgaaacttt

SEQ ID NO: 8094 - DNA, 933 bp, Arabidopsis thaliana
atcatttcttcttcttcttcctcactttgttcatcatcttcttctccgatctaaacaacaatggcgacaccaggagcttcctcagcaagagatgaattcgtatacatggcgaaactcgccgaacaagcagagcgttacgaagaaatggttgaattcatggagaaagtcgcgaaagctgttgacaaagacgaactcaccgtcgaagaacgtaatctcctctccgtcgcttacaaaaacgtcatcggagctcgtcgtgcttcgtggagaatcatttcatcgatcgaacaaaaggaggagtctcgcggtaacgatgaccacgtttcgttgatccgtgactacagaagcaaaatcgaaacggaactttctgatatctgtgacggaatccttaagcttctcgatacgattctcgttcccgctgctgcttctggagattcgaaggtgttttatctgaagatgaaaggtgattatcataggtacttggctgagttcaaatctggtcaagagaggaaagatgctgctgaacatactcttactgcttacaaagctgctcaggatattgctaattctgaattggctccaacgcatccgattcgtcttggtcttgcgttgaacttctctgtgttttactatgagattctcaattctccagatcgtgcttgtaatctcgctaagcaggcgtttgatgaagcaattgctgaattggatactcttggtgaagagtcatacaaggacagtactttgattatgcagcttcttcgtgataacctcactctctggacttctgatatgcaggacgatgttgctgatgacatcaaagaagcagcaccagcagcagcaaaacccgctgacgagcaacaatcctaagtcgtcttaccgcaactttgttgtcatttcagtatctaaaacctctccattaatatgtttttctcttgg

SEQ ID NO: 8095 - DNA, 2217 bp, Glycine max
cggatatccacttcctcttcttctcttcccatttcccttccaatctcctaatttctcttcagcttctgggttctccattttccttcgtcttctgcatctgcattccgtagattcagttctcgtcggaaaatggacgttcgccgaagacccattcctccctccggcgatcgccgacaaacccagaagctgaagaacaccgccaccaccgattcgcagactcttctgcctctctacctcaccaacgccctcttcttcgcggtgttcttctccgtggcctacttcctcctccaccgctggcgcgagaagatccgcaccgccactcccctccacgccgtcacccccgccgagaccgccgccatcgtctccctcgtcgcctccgccgtctatctcctcggcttcttcggcgtcgcctcccgcgcctccctcgacgagctctccgacgacgagatcatcctcaaggaagactcccgcgccccgggcccgtgcgccgcggcgctgtcggactcctgctcactccccaacaacaaaatccaagaccaattccctctgccacccagggctgtccacagtttggcgaaggaaaaacaacatattccttcgccaccacaagtggacagtcctgtctctgtctcagtctcggtctcttcctcctcggacgacgaggacgaggagatcgtgcaagccgtagtgtcgggctccatcccgtcctactcactcgagtcgcggctcggtgacacccgtcgggccgccaccatccgccacgaggtggtgcagagactgacttcccgatccctgtcaggtttacctctggaaggtttcaactacgactcgatattggggcagtgctgcgagatgccgatagggttcgtgcagatccccgtgggagtagcggggccattattgttggatggaaaagaattcaccgtgcccatggccaccactgaagggtgtctggttgcgagcaccaacagaggttgcaaagctatatacgtctccggtggggcctcctcggtgttgcttagggatggtatgaccagagcacccgttgttcggtttccctccgcccagcgcgccgcgcagttgaaattcttcttggaggatcctctcaacttcgattctcttgctgtcgttttcaataagtcaagcagatttgccaggttgcagaatattcagtgtgctattgcgggcaagaatttgtacatgagattccgatgcagcactggtgatgcaatggggatgaacatggtgtcaaaaggtgttcaaaatgtccttgattttcttcagagtgacttccctgacatggatgttattggaatttctggaaatttctgttcggacaagaaagctgcagccgtgaattggattgaagggcgtggcaagtctgtggtgtgtgaggccataattaaggaggatgtggtgaagaaggtgttgaagaccagtgtggaggccatggtcaagcttaacatgctcaaaaaccttacgggttcagccatggctggtgctcttggtgggttcaatgctcatgctagcaatattgtgtctgctatctacattgccactggtcaggatcctgcccagaatgtggagagttctcactgcatcaccatgatggaagctatcaatgatggcaaggaccttcatgtttccgtgaccatgccctccattgaggttggtactgttggaggtggcacacaactcgcatctcagtcagcatgtcttaatttacttggtgtcaagggtgccaacaaagaatctccgggtgcaaattctaggctactggccaccattgtagccggttcagtcctcgccggggagctatcgctcatgtctgctattgcagctggacaacttgttaagagccacatgaaatacaacagatctagcagggatatatctacaattgtccaatgaactggccacagtacacttaaacttgtgtcagagactaatattctaataagcaaaccatcagataaagacataaataacgagaaaaaaattggtattgatgatggtgggggtaaaagataaagtgatggttggcatcttccatgggcaaatccagctccccagaagcgtggggttggttggcattcattgaatatctgcttcgtgtgaggcattttctcttatggagattgtacagaggtacttgaattagagggtggaggtaaacaggagccacacttttgggattagagtttctctttgttttcc

SEQ ID NO: 8096 - DNA, 1244 bp, Glycine max
ggcgtcatttcatttccaccaaacaccaaagaaagaggtgaagtcaaatggtccttagttctgggagtgttgatgcttgagtcttgacggaacgaacggaaaaggggatctcaatggacaacaccaagccccttatcgaactggaactcgacgatgatggcagaatcagaagaaccgggaatgtgtggactgctagcatacacattataacagtggttgtaggggcaggggtgctgtctttggcatgggttatggcacaactaggatggttagctggcatagccagtatcattaccttttcagctgtctccattttcacttacaatcttgtagctgattgttacagatatccagaccctgtcactggcaagagaaattatacttatatgcaggctgtcaaggcttacttaggtggaacaatgcatgtgttttgtggattggttcaatataccaagctcgctgggatcacagtggggtacacaataacttcctccacaagcttggtagcaataaggaaagcaatttgcatccacaaaacaggagatgcagcttcttgcaagtttttgaataatcccttcatgatcggttttgggatcttgcaacttttcttgtcccaaattccaaacttccatgagcttacatggctctcaactgctgcctgtatcacctcttttggttatgtattcattggcagtgggctgtgtctcttggtcgtcctctcaggaaaaggagcagcaaccagcataaccggaaccaaactacctgcagaggataaacttctgagggttttcactggattgggaaacatagctcttgcatgcacttacgctactgttatttatgatataatggacacattaaagtcccatccatcagaaaataaacaaatgaaaagggctaacgtgctaggggtcacagcaatggcaatattgttcttgctatgcagtggccttggctatgctgcttttggtgataacacacctgggaacatcttgactggatttaccgaacccttctggttggttgcactggggaacggattcatcgtaatccacatgattggagcatatcaggttcgatcattctttcactgaaacataattaagttactcatttttaattttgttcttgtaaaatatttttgtatttaatttgtaatttactgaaatatacgcttttaatccgtatcattatatttctgttcttgaataatgacttgatataacgagaccgtgttacttgtc

SEQ ID NO: 8097 - DNA, 1484 bp, Glycine max
ctaatccaccctttctgaacaaaaataaaaaaataaaaaaaaacccatcgatttcttggacctccatgacttctttgtctacccatcacacctatagccgaaagcaaaaatctctcggcctcctctgcaccaattttctgagtttgtacaacaaagaaggtgtgcgcctggtcggtctcgatgacgcagcttcgcggttaggtgtagaaagacgtcggatctacgacatcgttaatgttttagagagtgtcggtgtgctaaccagaaaagctaagaatcagtatacttggaaaggattttgtgcaattcctgctgccttacaagaacttaaggatgaaggtttgaaggagaatcctggatcatttgatgactccaatgacaatgcaaaagtgtctgatgatgaggaggaggaagaagaaacatttcctaatattaacattgggagtcagagtgagaaggaaaatcctgattacactgctactgtcaaatcctccaagaatgaaaacagaagggaaaaatctctggcattgcttactcagaattttgtcaagctttttgtctgctctaattttgaaatgatctcccttgacgaagctgcaaagttgttgcttggaaatgccaacaatagaacaaaagtcagacgtctatatgatattgcgaatgtgttatcctccatgaacctaatcgagaagacccatacaacaaacacaagaaaaccagcattcaggtggttgggtgtgaggggaaaaacatggggtggatcagttgacttggctcaaaattcaaatgtcaaagagtcacggaaaaggatgtttggaactgacattggaaacataagttttaaaaggaacaaagttgatttgtccatggatggccagaattctaaaatgcaaaatcaacacgaaaatattagtccacgagctcagttagagaaaatcatcataaaaaaagatgctaagcagacttcagagagctatcagtttggcccttttgctccagcttatgtgcccaaagttggaacctctgaaaataatagtgtgaaaaaggtgcatgactgggacagcctcgcacaggagcatcgtcctcaatatcaaaaccaaggttagagctttaaaagatctattttcccactacatggaagcatggaaatcttggtactctgaagctgctgggaaaaagtcaacgaaaactttataattgacttgtccaaagtcagtccagataattgtagcttttctagaaaataaatgatccattactgagtgtatgttccacatatgttggcatattctcaaaatgaaatgatccattactgaatgcatgttctccatgcgttactgtattctcaaaagaaaatgatccattgttgaatccatgttctccaggggttagcgtacagctaccctgtgctgatttattaaccgtcacatgtcatgttaaagatcagttaacagttcttatagattatttatcatgttttttat

SEQ ID NO: 8098 - DNA, 1455 bp, Glycine max
ttccttcatttccatccccttctctcttttaaacctcacgcacaacgaaatcgtgattctgttgttcttttgaaatggaaaacgctccggtggtgtgtaaggaagatgatcagatggatttgcctcccggatttcggttccacccgactgatgaagagcttataagccattacctctacaagaaggtcattgacaccaagttctgcgccagggctattggagaagtggacctcaacaagtctgagccttgggatttgccatggaaagccaaaatgggagaaaaggagtggtactttttctgtgtgagagacagaaaataccccactggcttgagaaccaacagggccaccgaagctgggtactggaaggccacaggaaaagacaaagagattttcagaggaaaatctttggttggaatgaagaaaactcttgttttctacagaggtcgagcacctaaaggtgaaaaaagcaattgggtcatgcacgagtacagactcgaggggaaattctctgttcacaacctcccaaaaactgcaaagaacgagtgggtgatttgcagggtgtttcagaagagttcagctgggaagaaaactcatatctcggggataatgaggttggactcttttgctgatgaattgggttcttctgctctgccacctctctcggattcttcgccttctatcggtaacactaaacctcttaatgatacggcttacgtgccctgcttctccaatccaattgatgttcaaagaaaccaagaaggtgtctttgattccttcaccaactctatctatgcggtttcttcaaatcctatgggcattcttcccagaatgccaccttctggctccttctactccactcaaggtgttcaagctgcgcctaatttggcatttcctggttctgtttacacccttcaggatcacaccatcctgagaaccttatgtgaaaacaatggttacaagccagagagggacatgatcagtgtttcgcaggaaacgggtctaactactgatatcaacgctgaaacctcttcaaattttgatatgggtaggaggccctttgagaatcacaatcatgcatctgtttctgttgccccattggatcttgatggtttgtggaattactaaaagtttaaataaaaggatcaattacagtgaatagtgaaattaaccccacttttgagctagaaggaagaggaaaaagaagagcctcggatgggattgatgctattgttgtttaatttctctgtatagattttatctaagacatgcatgtactgaagcatatgttgttaagtgtaagaaatgttgtggaatgaattaggctggtttggtctgttgacactttaggcttgtgcgtggctggcatgagcatgagcatgagcatgagcatgattaatttgtttcagtttggattaaaaataatagtagaatgggactggtggattaaaattag

SEQ ID NO: 8099 - DNA, 1315 bp, Glycine max
caaaacggtcgcattcgtctcctccagagattcaacaaacgctccccacaacttgagaaccttcgagactaccggattgtccagtttcagtcaaaacccaacacaatccttctcccccaccatgctgacgccgatttcctcctctttgtccttagcgggagagccatacttaccttggtgaacaacgacgacagagactcctacaaccttcaccctggcgatgcccagagaatcccagctggaaccacttactatttggttaaccctcacgaccaccagaatctcaaaataatcaaacttgccatacccgtcaacaaacctggcagatatgatgatttcttcttatctagcactcaagcccaacagtcctacttgcaaggcttcagccataatattctagagacctccttccatagcgaattcgaggagataaacagggttttgttgggagaggaagaggagcagaggcagcaagagggagtgatcgtggaactctcaaaggaacaaattcggcaactgagcagacgtgccaaatctagttcaaggaaaaccatttcctccgaagatgaaccattcaacttgagaagccgcaaccccatctattccaacaactttggaaagttctttgagatcacccctgagaaaaacccacagcttcgggacttggatatcttcctcagttctgtggatatcaacgaaggagctcttcttctaccacacttcaattcaaaggccatagtgatactagtgattaatgaaggagatgcaaacattgaacttgttggcattaaagaacaacaacagaagcagaaacaggaagaggaacctttggaagtgcaaaggtacagagctgaattgtctgaagacgatgtatttgtaattccagcagcttatccatttgtcgtcaacgctacctcaaacctcaatttccttgcttttggtatcaatgctgagaacaaccagaggaacttccttgcaggcgagaaagacaatgtggtaaggcagatagaaagacaagtgcaggagcttgcgttccctgggtctgcacaagatgttgagaggctattaaagaagcagagggaatcctactttgttgatgctcagcctcagcagaaggaggaggggagtaagggaagaaagggtccttttccttcaatcttaggtgctctctactgaataactacgtaaatgtatgctgtaagagctcatcgtgagcgtggaatgtatctgcccatgtaactataaaaacttgagctccacctatcttctatctactacgaataaataaatccagcatatgatgcttgtgttttgt

SEQ ID NO: 8100 - DNA, 2065 bp, Glycine max
caaaaacccattcacttttccacaagccttagttcttctcatttattctctttttcaaaatactttcactctctctaaccttccagttctcactaaacctcgtgaagctcgtgatggacaccaagataggttcactagacgcgcccaagcccaacagcaacgacgtcgtatcatgcaacctcaccagcagcgccgccatccagccctgcttgccggcgacggtgatcaacggcgccggctgtagtgactccaccttgggcggccacctggcccgccggctggtggaaatcggcgtcaccgacgtgttctccgttcccggggacttcaacctgacgctgctggaccacctcatcgcggagccggcgctgcacctggtcgggtgctgcaacgagctcaacgccgggtacgccgccgacggctacgcgcgcgccaggggagtcggcgcgtgcgtggtgacgttcaccgtcggcggcctcagcgtgctcaacgccatcgccggagcgtacagcgagaacttgccgctaatttgcatcgtcggtgggcccaactccaacgactacggcaccagtcggatcctccatcacaccatcgggttacccgatttcagccaggagctaaggtgctttcagaccattacttgcttccaggctgtggtgaataacttggaagatgctcatgagttgattgatacagcaatctcaactgcgctgaaagaaagcaaacctgtgtatataagcattagctgtaacttgcctgggattcctcaccccactttcagtcgtgaccctgttcgtttttcattgtctccaagattgagtaataagatggggttggaggccgcagtggaggcagcggcggaattccttaacaaggcagtgaaaccagtgctggtaggtggtcctaaactgagggtggcaacagcatctgatgcctttgtcgaactggctgatgcgtgtggttatgcgcttgctgtgatgccgtcggctaaagggcaggttccagagcaccatccccattttatcggaacttattggggtgctgtgagcactgccttctgtgctgagattgtggagtctgcggatgcatacttgtttgctggtccaatttttaatgactacagctctgtggggtattcacttcttctcaagaaggagaaggcgatcattgtgcagcctgatcgggttgtgatcgcgaatggacctgcttttgggtgtgtgctgatgaaggatttcctcaaggcactcgcaaagcgcctcaagcacaacaatactgcatatgaaaattaccacaggatatttgtccctgatgggcatcctttgaaggctgcacccagagagcctttgagggttaatgttctgttccaacatatacaaaatatgctgtctggtgaaactgctgtaattgctgagacaggggactcctggtttaattgccaaaagctgaaattgccaaaggcatgtgggtatgagttccaaatgcaatatggttcaattggatggtctgttggtgctactctgggttatgctcaagccgttcctgagaagcgagtgattgcctgcattggtgatggaagttttcaggtgactgcccaagatgtatcgacaatgttacggtgcgggcaaaaaaccatcatctttctgatcaacaatggtggatacaccatcgaggttgaaattcatgatgggccgtacaatgtgattaagaactggaattacactgggttgattgatgcaatccacaatggtgaagggaaatgctggactgccaaggtgttctgtgaagaggagctagttgaagcaattgccacagccacaggacccaagaaagactccttatgcttcattgaggtgattgttcataaggatgacaccagtaaagaattgcttgaatggggctcaagggtttctgctgccaatagccgtcctcccaatcctcagtaatcttcagaatttatcctatgactaaattgctgcagttgccctttagctctatgaaagtgagaatcatttgagatgatgcccttgtagggaatttacctttgttaatggcttgaaacatttatgct

SEQ ID NO: 8101 - DNA, 1408 bp, Glycine max
gtcgctaatcctagttccttcaactcctcgctggcaacaacagcagtactaccattagccgcgtttttcaaaagtgattttcgagaattagcgatgggaattgaaagaggaggcttcaagggattcaggagcgcctggagcgtgccgcccaagccgtgcgattcctgcaagctggcctcggcggcgcttttctgccgccccgattccgcgtttctctgcatcgcctgcgattccaacattcactgctcgaacaaactcgcgtcgcgccacgagcgcgtgtggatgtgtgaggtgtgcgagcaggcacccgctgctgtcacgtgcaaggccgacgccgccgccctctgcgtcacgtgtgactccgacatccactccgcgaaccccctcgcgcaacgccacgagcgcgtccccgtggaacctttctttgactccgctgagtccatagtgaaagcctctgctgccgccaccttcgggttcattgtcccatccgacgacggcggcgcctccgacgctttcgcccccgatgactccgacgccgccgcgtggctcatcccgaaccctaatttcgggtccaagctcatggacgcccccgaaatcaagtccaaggagatattcttctctgaaatggaccccttcctcgattttgattactcaaactccttccaaaacaacaacagcgccggaaacgacagcgtcgttccagttcaaaaaccctctctcgcccctcccctaatcaataatcaccaccaccaccaatcagaaacttgcttcgacgtcgatttttgtcgctcgaagctctcctcctttaactacccttccaattctcttagccaaagcgtttcgtcgtcgtcgcttgatgttggagtggtgccggacgggaatacggtgtcagacatgtcgtattcttttggtcggaacagttcggattcgagtgggattgttgttgtgtcaggaaatagtgtggggcaaggtgcgacgcagttgtgtggaatggatcgggaagcgagggtactgcgatacagagagaaaaggaagaaccgaaaattcgagaagacaattcgatacgcatcgcgaaaagcatatgcggaaacccggcccaggataaaaggccgcttcgccaaacgaacagaaattgactcggatgtggagcgtctctatagccctggccctgcggtgctcatgctggacactccatacggcgtcgtaccatcgttttagttaatttcaaaatgaagaaacgatggagtgcatgaatcttagaataatgattagcgattctgtgggattgttaggggaaaaaggtgaagaatcgaatcggtacgaacgtgattcttagctggagcgcgatgggggaagattattgtgaagatttgtctcgatcgaccagaaaagcccgtttactttttat

SEQ ID NO: 8102 - DNA, 1236 bp, Brassica napus
gttataaatgaaagcgactctcgcaccctcctctctcataagcctccccaggcacaaagtatcttctctccgttcaccgtcgcttctccttcagtcccaacggccatcctcagccttaatgacgacgacgacggcatcacgtggaagcgtggctgtgacggctgctgctacctcctccgttgaggcgctgcgggaaggaatagcggaattctacaacgagacgtcgggattatgggaggagatttggggagatcatatgcatcacggcttctacgatcctgattcctctgttcaactttcagattccggtcaccgggaagctcagatccggatgatcgaagagtctctacgtttcgccggcgttactgaggagaaaaagataaagagagtagtggatgttgggtgtgggatcggcggaagctcaaggtatattgcctctaaatttggtgccgaatgcattggcatcacactcagtcccgttcaagccaagagagccaatgatctcgccgccgctcaatcactctctcataaggtttccttccaagttgcagatgcactggagcaaccatttgaagatggtatattcgatcttgtgtggtcaatggaaagcggtgagcatatgcctgacaaggccaagttcgtgaaggaattggtacgtgtggcggctccaggaggaaggataataatagtgacatggtgccacagaaatctatctccaggggaagaggctttgcagccatgggagcagaacctcttggacagaatctgcaaaacattttatctcccagcctggtgctccacctcggattatgtcgatttgcttcagtccctctcgctccaggatattaagtgtgcagattggtcagagaacgtagctcctttctggccggcggttatacgaaccgcattaacgtggaagggccttgtgtctctgcttcgtagtggtatgaagagtataaaaggagcattgacaatgccattgatgattgaagggtacaagaaaggtgtcattaagtttggcatcatcacttgccagaagcctctctaagtttaatctataaacaataaaattgtcttttaagtgcttttcagcgaattgatttctatctatgatataggagattgaataagagtcgcttaagaaatgtggatgcatgagatcccttaacgtcatgaatattgtagttgatgtccactatggaatgttctaaatttacttgattcctaaaaggacct

SEQ ID NO: 8103 - DNA, 1118 bp, Glycine max
gattgcatcgttgttgttcccttcttttttctttctccgccccttttttgttgttccttcttctcgttcgtcgctttgtgatctctctctgcaaccatgtccgtcgagaaagagagagagacccaggtttacttggccaagcttgccgagcaggccgagagatacgaagaaatggttgagtgtatgaagaaagtagcaaaacttgatcttgatctgactgtggaagaaaggaaccttctctcagtgggatacaaaaatgtgattggtgcacgaagggcctcttggcgcataatgtcctcaattgagcagaaggaagagtctaagggaaatgagcacaatgttaaactgatcaagagttactgccaaaaagttgaggaggaactctccaaaatctgtggtgacattctgactattatagaccagcatttgattccttcttccggatcagcagaagctagcgttttctactacaagatgaaaggtgattattttcggtatcttgctgagttcaagactgaccaagaaaggaaagaggcagctgagcagtcactaaaaggatacgaggctgcttctgccactgcaaacacagatcttccatcaacacatccaatccgtcttggacttgcactcaatttctctgtcttttattatgagataatgaactctcctgaaagggcctgccatttggccaagcaagcttttgatgaggcaattgcggagttggacaccctgagtgaagagtcatacaaggacagcactttgatcatgcagctgttgagagacaaccttactctctggacttccgatttaccagaggatggaggtgaggacaacataaaagctgaagaagccaaaccttctgagcctgagcattgatgtgattcagtagtcagaaatctaaggtactccccaagagggcatttttcagcttttcttgcaatggatttggaccggacaatagggaccgtggtggccatttcataattcttgttctctcttaatatctttaccaaagccagaagatctgcacccttttttttcccttaaaactttttatttttattgccttctctgttttaagtggtcagttaagcaatgaacaatttacatttaccctt

SEQ ID NO: 8104 - DNA, 1736 bp, Glycine max
gaacatgaacattagcagaaaataaataagacccacttgttagattggttacactagcagcacgcagggttctgttctgctttgcattctccgccatcatcatgcaagcgcttcactctcccaccctccgcgcttctcccttggaccctcttcgtggccccaacaatgccgccgccaaccgccgctcctccagcgccaagcgcgtgttcttcgtctccgccacggtggcgccgaaggtgtccgccccgcagcgacagaaggaccccaagaagcgcgttgtgatcaccggaatgggcctcgcgtcggtgttcggtaacgacgtggagggttactacgagaagctcctcgccggcgagagcggcatcaccgccatcgaccgcttcgacgcctccaagttccccacgcgtttcggcggccagatccgcggcctctctgccgagggctacatcgacggcaagaacgaccgccgcctcgacgactgcctccgctactgcattgtcgccggcaaaaaggccctcgaaaacgccgaccttgcccccgacaaccactccaagattgataaggagcgtgctggtgttcttgtaggctctggaatgggaggcttaacggtgttttctgacggtgttcaggctctgattgagaaggggcacaggaagataacgccgtttttcattccttatgcaattactaacatgggttcggctttgcttgggatagaccttggattcatgggtcccaactactctatatccacggcttgtgctacttccaattattgcttttatgctgcggcgaaccatattcggagaggggaggctgatttgatgatagccggtgggactgaggctgccattattcctattgggttagggggttttgttgcttgcagagcgctttctcagaggaacgacgaccctaaaaccgcttccaggccatgggataaggaacgtgatggctttgttatgggtgaaggtgctggagttttggtaatggagagcttggagcatgctatgaagcgaggcgcacctattattgctgaatatttgggaggagctgttaactgtgatgcttatcacatgactgatccaaggtctgatggacttggtgtgtctacatgcattcagagcagccttgaagatgccggtgtgtcaccagaggaggtcaactacataaatgcacatgcaacttccactcttgctggagacttggcagaaattaatgctattaaaaaggttttcaaggacacttctggcatcaaaattaatgccaccaagtctatgatagggcactgccttggtgcagctgggggtttagaagccattgccacagtgaaagccataacaacaggatggctgcatccaacaatcaatcaatttaacccagaacctgcagttgattttgatacagtggcaaatgtcaagcagcagcatgaaatcaacgttgccatttcaaattcatttggattcggtggacacaactctgtggtggcattttctgctttcaagccttgattgcccagcttagcttgtctgcactttatgtagaacacgggtttaagttaattgaaattttgttccctctacatcattgaggttatttactctagctgagtccatcatcatatataaaaagctgtaggcatgtagtcgttcattttgtgcctaattgtgacttgacaattagctataagactattttgtagtagaacattttgaatatagctcgaagattttatt

SEQ ID NO: 8105 - DNA, 593 bp, Glycine max
gatcatcaaatcaaaaaccctaattcccaaattctctcatttttcaagtttcaaccaagaaaagcagcaacaatgtcgggtcgcggaaagggtgggaagggtttaggaaagggaggagcaaagaggcatcgcaaggtgctccgcgacaatatccagggaatcacgaagcccgcgattcggagactggcgagaagaggtggcgtgaagagaatcagtggtttgatctacgaagagaccaggggcgtgctcaagatctttctcgagaacgtgattcgcgatgccgtgacgtacacggagcacgctaggagaaagacagtgacggccatggatgtcgtttacgctctcaagaggcagggaaggactctctatggtttcggaggctgagggtttggccttctttggtggctttggtttgtgtaaatggaaggaatttgtgttttgtagtgattatatatgtacttggattatcttctgctcggtacatgctcaaggttcttctgttttttttttttaattctactagtaattgcatcctaattgttttgaattgaagtaaatttagtgaatgatgaatgttggatgttctatttcgc

SEQ ID NO: 8106 - DNA, 980 bp, Glycine max
gcgagaagacgacagaagggaagaatgtgattggtgctcgcagagcgtcctggaggatcctgtcttccattgagcagaaggaagaaacaaaagggaacgagttgaatgcgaagcggattaaggagtacagacagaaggttgaattggagctatcgaacatctgtaatgatgttatgagagtgattgatgagcaccttatcccttcggctgcagctggtgaatccactgtgttttactataagatgaaaggagattattatcgttatcttgctgaatttaagtcaggcaatgagaagaaggaagctgctgatcagtctatgaaagcatatgagtctgctaccgctgcagcagaggctgatttacctcccacacatcccatccgattgggtctagctttaaatttctctgttttctattatgagatcttgaactcccctgaaagagcctgtcatcttgcgaagcaagcttttgatgaagctatttctgagcttgacaccttgaatgaggagtcatacaaagatagcaccttaatcatgcaacttctcagggacaacctaactttgtggacttctgacatcccagaagatggagaagatgcccagaaagtgaatggcactgccaagcttggtggaggtgaggatgcagagtgagtccgatggatgatggaatcttccataggattcgatgcatgcgtttgggaatgaaacatgagggccgattacttatctgtgtattagctagagatagggattctattgtttcctctttgtttcctgttggattgcccaatacttcccgataggggaaagagatactccatttgtgctatatttatggtatgtttttatttgtgtggtgtctggaaatggcctatttcattcccaatccgtttcctccagtctctgggggatttgattgatgagaattgcttatggtgggtgtatttccttttccaatgaaatgctacaacatttactgct

SEQ ID NO: 8107 - DNA, 688 bp, Glycine max
gctgcgagacgacagaaggggagatatacattctcttgtcacagttttctgtgtcaccggaactcgtttctttcaaaacacttcaaacatctcgaacgctctctttccggcaactaggttaaagttcatcaatggcaggtcgcggcaaaaccctaggatctagcgccgccaagaaggctacctcaaggagcagcaaagccggcctccaattccccgtcggccgtatcgcccgtttcctcaaggccggaaaatacgctgagcgtgtcggcgccggcgcccctgtctacctcgccgccgtactcgaatatctcgcggctgaggttttggaattggctggaaacgctgcgagagacaacaagaagactcgaattgtgccgcgccacattcaattggcggtgaggaacgacgaggagttgagcaagctactcggtgacgtcaccatcgctaacggtggcgtcatgcctaacattcacaatcttctccttcccaagaaggctggtggatcatccaaggctgctgctgcagacgatgactcttaaataggggttttttttccgtgaaaagttatcgaatttattctctttggattctctctgtttttgtagtttttcagtttttgataattgtgttctgtagatgtagttaggttttcagtcactgatgtgaatagagaacgctctttttctcc

SEQ ID NO: 8108 - DNA, 687 bp, Glycine max
cccacggtccgaagacgacagaagggggatcgctctcacacctgtgattattcctcttttaacaatccacacccaaattctagggttccgaaatggacgctggcggaaagatcaagaagggcgccggaggtagaaagggcggcggcccaaagaagaagccggtttcaaggtccgtcaaagccggtctccaattccccgtcggaagaattggccgttatttgaagaaaggaaggtacgctcagcgtgtcggtaccggtgctcccgtatacttggctgcagttctcgaatacctagctgccgaggtgcttgagttggctgggaatgccgcacgtgacaacaagaagaacaggattattccaagacacgtgcttttggcagtgaggaacgatgaggagttggggaaattgcttgctggagtgacaattgcacatggtggcgtgcttccaaacattaaccctgttttgttgcctaagaagaccgagagggcttccaaggaacctaaatctccatccaaggctaccaaatctcctaagaaagcttaagtgtttttattttattttatttgaatatgtaaatcagtctttagatgctttttatgtgaaagaaaaaattatctattgcaaacactgtaattcctatcgtctcgcatgtaggagtttgctacattaatgaaatcttctttatttc

SEQ ID NO: 8109 - DNA, 620 bp, Glycine max
gggaaaagaggcgagggtagctcatgacatgttccttgaaggaaaaaaacgcagttgaaagattgaagctcgagatgtcggggaaaggcgcaaagggtttgataactgctaagaacccttcttcctctaaggacaaagacaagaaaaaacccatttctcgctcctcaagagccggtcttcagttccctgttggacgcattcatcgtcttctgaagtcaagggtgacagcacatggaagagttggggcaacagctgcagtttattctgctgccatcctggagtatttaactgcagaggtgttggagttggccggcaatgcgagcaaagatctgaaggtgaagcgtattacccctagacatctacagctcgccatccggggagatgaagaacttgataccctcatcaaaggaacaatagctggtgggggtgttattcctcatatccacaagtcccttatcaacaagtcctcaaaggaatgaggagggtttatacattatttgaatcaagaaattgactgtaaatttggctatatcttttgatatggataatttgctccctgcattagtttggttgaactcaacttcaaaagaaatatgaaaatgtcttatttcttcatttgc

SEQ ID NO: 8110 - DNA, 513 bp, Glycine max
gatccaaattcaagttcgcaccaaattttcctcccaaaatgtcaggccgtggaaaaggtgggaagggtttgggaaagggaggagctaagaggcacagaaaggttcttcgtgacaacattcaaggaatcacgaaacctgcgattcgtaggttagcgagaagaggtggcgtgaagaggatcagtggtttgatttacgaggaaaccagaggagttctgaagatattcttggagaacgtgattcgcgatgctgtaacctacactgagcacgctaggaggaaaactgttactgctatggatgtcgtttatgctctcaagagacagggaaggaccctctatggctttggaggctaaagaatagaatctttaggtttaatgactgtgttgcaggataaaacattggttcttttgaatttgcgtgaagtttagtttaggttttggtttgttctgtaacatacgaagctatgtttgctcagaaaatgtaaaacttcaattgaaatctaaatgaaggagtgtt

SEQ ID NO: 8111 - DNA, 1093 bp, Glycine max
ggtctccctcatttgttcactttctctctctaaatccctaaaccagatctcgcactcgcgctttctctctctaggattcgacaatggcggccgctccctcgcctcgcgaagagaacgtgtacatggcgaagctcgccgagcaggccgagcgctacgaagagatggtggagttcatggagaaggtctccgccgccgccgacaacgaggagctcaccgtcgaggagaggaacctcctctccgtcgcgtacaagaacgtgatcggagcgcgccgcgcctcgtggcgcatcatctcctcgatcgagcagaaggaggagagccgcggcaacgaggaccacgtctccgtcatccgcgactaccgatccaagatcgagtccgagctctccaacatctgcgacggtattctcaagctcctcgactctcgcctcattccctccgcttcctccggcgattccaaggtcttctacctcaagatgaagggagattaccacaggtacctcgccgagttcaagaccggcgccgagcgtaaggaggctgccgagagcactctctctgcatacaaagccgctcaggacattgcaaatgccgaactgcctccaactcatccaattaggcttggccttgcacttaacttctctgtattttactacgaaatccttaactctcccgatcgtgcctgcaaccttgcaaaacaggcttttgatgaagctattgctgaattggatacactgggagaggagtcatacaaggatagcactctgatcatgcaactccttcgtgataacctcaccctttggacctctgacatgcaggatgatggagcagatgaaattaaagaagcagcaccgaaacaggatgaccagtaaaaatattttactgctaattagaattgaacttctcctccatatctttttgaagggagaaggtgtttgttgctaatatctctttggtactgagattttaggcattcatgtttgttatgattgtggatgtactgggccgtttttagtttgtccttccattttcaagtgttttccaaattgcctattttattaaggacgctgaagtttttattatatggaattggaattttaag

SEQ ID NO: 8112 - DNA, 697 bp, Glycine max
ggacatcataggcacccatttggatctaatcctcagaatcagcttcagcctttctctctaactccctcactcacactcacagttaagcaatggcggggaaaggaggaaaggggcttcttgcagcgaaaaccaccgcggctaacaaggacaaagacaaggacaagaagagacctatttctcgttcatctcgtgccggaatccagtttcctgtgggacgtatccataggcagctgaaacaaagggtccaagctaatggacgtgttggtgccactgctgccgtatacttagcctcaattcttgagtatcttactgctgaagttcttgaacttgctgggaatgcaagcaaggatctgaaggtgaaaaggataacaccaaggcatttgcagcttgctatcagaggagatgaggagttggacacccttattaaagggaccattgctggtggtggtgtcattcctcacatccacaagtccttgatcaacaaaacagccaaggattgagctcgctctttggccttctgatttcatgttgctgtttactgagaactaagtttgtgtttattgtgaattgatcacagtagtaggtttgtatgaatgatttattttaacagttttataactcaggttgtagtgtgtacatggcttgctagacaatgctttctttaactattttaatgggtctgttgttagagctttag

SEQ ID NO: 8113 - DNA, 1295 bp, Glycine max
gataaaaggagatccaaagtaaagaacacagatggcatgacaccacgaaaccaaattaaaaactgcgccttctctgtctctgtttgttcttctcactttatattctctctctgtgtatatctcttcactcttattattccttctcttctcaacgacgatggaggacccatcagcagcaacaacgttgttgctgaacagcgaatattcgaggctgttcgtcgaggacacggacttgtacaatcgcattgtgttgggaaccctcttgccgcacttcgtgtggggcccactcccgcacttcctccagacgtggcttcgcaattacctcggcggcgtcctcctctacctcctctccggcctcctgtggtgcttctacatttattattggaagcgcaacgtttatgttcccaaagatgctattccctctcgaagagccatgctcttgcaaatatctgttgctatgaaagccatgccttggtacactttgcttccaactgtttcggagtacctggtagaaactggctggacaaagtgctatcctagattatataatgttggttggcttgcataccttgtgtatttagcaatttatctaagtattgtagagtttggtatttattggatgcacagagaactgcacgacataaaaccgctttacaaatatcttcatgctacccatcacatctacaataaacagaacactctctccccttttgctggtttggcatttcaccctcttgatgggatacttcaggcattacctcatagcctttgtttgttttttatgccaatccattttactacacatttagtcctcatattcattgagggcatttggactgctaatattcatgattgcattcatggaaaattgtggcctgttatgggtgctggttaccacaccattcaccacactacatatcggcacaactatggccactacaccatatggatggattggctatttggaactcttcacaaccccgaggaggacgagggcaaggctatgtgatgaattgcagacttacattggcagtcatttattatcatgtttggattgttgaaatgtgcttacttgcatgtaaagcataaatgtgttagctatatttttctggtgtttcatcacaaggtgatggctctatattagagagacagggttgagggttaaagtggagcttccctgtctctaatcccattgttagtgtatgtgattgaggttattttctttctcaaattgtgtggtagagttgagatagtaatgcagttttttcttttttgaaggtaatgcagttttctct

SEQ ID NO: 8114 - DNA, 1159 bp, Glycine max
gattccttttcctttctatctctctctcttcttatatttccacattccacgtgaaccttctagaactataatagaaagaaaccctccattccatggctccgccgctcgaacacaacggcgtttccacgagcggtgactctcagagatccattcccacgccgtttctcaccaaaacctaccagctcgtcgacgatcacaccatcgacgatgtcatttcgtggaacgattctggatcgtccttcatcgtctggaacaccaccgctttcgccaaggatttgcttcctaaatatttcaagcacaacaacttctccagcttcgttcgccaactcaacacttatggatttagaaaagttgtacctgaccgctgggagttctcgaacgagtattttcgaagaggcgaaaagcgtcttctctgcgaaatccagcgacggaagatcctctccgcatctcctccgccggcgggagcaactgccaccgtggcggttccgtcgccgctgccgctatctgcgatcccgacggcgaagccgatcgtgtcgccgtcgaactccgcggaggagcaggtgctttcgtcgaactcgtcgccggcgagagcaccggtggagctgttggacgagaacgagcggctgagaaaggagaacattctgttgacgaaggaattggtgaagatgagatcgctctgcaacaatatattcaatctcatgtcgaattacgctaacgctcaagcggacggtagttccgcggcggcggcgaagcggtgctccggcgaggatgcggtggaggagatgaatccgaagctgtttggggtggcgattggtaagaagcgagcgagagaggaggaaggacatggagcgaagtatgatacggctttgagtctgcatcagccgtttcatgcggacgtgaaatctgaagcgttggatttaccaggacgtggcgaaaataaaaaaacgccgtggctaaatcaatgtcatagagcaaatcagagggtgtgtaattgacacacgacgttgtaatagctaggtaacacgttaggttaagttaggggcgtcgtagagaatcagagtctgtaagcacggagacgcgcgtgtcaaatgtacgtcgttaaccgtttgggacttttttcgtagaagtttctcagaagaaaactatattttgttgttcc

SEQ ID NO: 8115 - DNA, 775 bp, Glycine max
gagattcgtcttcagtttcagcctttctctcccactcactcactcacaggtaagcaatggcgggaaaaggagggaaggggcttcttgcagcgaaaaccaccgcggcgaataaggacaaagacaaggacaagaagagacctatttctcgctcttcccgtgctggaatccagtttcctgtgggacgtatccataggcagctgaaacaaagggtccaagccaatggacgtgttggggcaacagctgcagtgtacttagcctcaattctagagtatctgactgctgaagttcttgaacttgctgggaatgcaagcaaggatctgaaggtgaagaggatcacaccaaggcatttgcagctggctatcaggggagatgaggagctggacactcttatcaaagggaccattgctggtggtggtgtcattcctcacattcacaagtccttgatcaacaaaaccgccaaggattgagctctctttggccttctgaattcatgttgccctttactgaaaactaagtttgtggttattgtgaattgatcacagcagtaggctagtacgaggatttgttttaacagttttagaactcaggtggtagtgtgtaaatggcttgcttgctagacaatgctttctttaactgttttagttggtctgtttttagagctttaaccatgttggattgctagacaatgcttgcttttagatacaatctgtgatctgttgttgtctttgttgcccattgaccccttcatatatggttgttttattttaatctttgc

SEQ ID NO: 8116 - DNA, 491 bp, Glycine max
attcataagtgtgacagaaatggaggatttaaaggaaaaggtcaatgaaggggaaccaacgcaaattaagtatagaggagtacgtaggagaccatggggaaaatttgctgcagaaattagagattcagctagacatggtgctcgtgtgtggctcgggacatttaacactgctgaggaggccgcaagagcttatgatcgtgctgcctttgagatgagaggtgctacggccattctcaacttcccagatgaacaccctccttgcaatgtgacttctcttagcaagaagtcctcatcatctaacactgagattggtaaacaagttgtggtatttgagtgcttggatgacaaattgttagaggaactccttgattgcgatggggaaaaccatcaatgaaaacttggattattaggaagataaggttcaactttttaatcctaaattggtatgtagtgcctgtgtacaattaaatacagtaaagttgcttagtgac

SEQ ID NO: 8117 - DNA, 517 bp, Glycine max
gggtctccactacgcattcggacaaaccctaacttctttttgctgttgttgggcaccaagatgaaagtgaacatcttgcaatggcatgctgttgcttcatggacttgggatgcccaggatgaaacctgtgggatttgtaggatggcctttgatggatgttgtcctgactgcaaacttcctggagatgactgcccactgatttggggtgtatgcaatcacgcatttcatctgcactgtatcctgaaatgggtgaattctcagacatcacaagcgcattgccccatgtgccgtagggagtggcagtttaaaggatgagagctcaggttttcattttctttttcgagtgtgaccagagagcaatgtaaattggtatggttaattcgaagatgtattgtttccttcatgttaaatctgtatcttcattgtaacttgtaaggagatcgaaatcaaagtttctgttaagtgcaagtttttttttccattaatgactaatgataatgtcctttctttgttttcc

SEQ ID NO: 8118 - DNA, 1415 bp, Glycine max
ctctgcgcggatggcaccatatcatttacagttttatcatgtgacaaacaagcgggtttggttcaatgccgatgcgagaactctgccactcttggtgagaggaagaatgttaatttgcctggagtgatagtggatctcccaactttgacagacaaagacaaggaagatatcttggcctggggagttcccaataaaattgacatgattgctctttcttttgttcgaaaaggttctgacctggtggaagtcaggaaagttctgggaaaacatgccaagaacattatgctcatgtctaaggttgaaaaccaagaaggggttgcaaattttgatgaaatccttgcaaattcagatgcatttatggtggcacgtggtgaccttggaatggaaattccaatagagaagatatttcttgcacagaaagtgatgatttacaagtgcaacatccaaggaaaaccagttgtcactgcaacccagatgttggagtcaatgatcaaatctcccaggccaaccagggctgaagctactgatgttgccaatgcagttctggatggcacagactgtgtgatgcttagtggtgaaaccgctgctggagcctatccagaccttgctgttcgaacaatggctaaaatatgcattgaagcagagagcacccttgactatggagatgtgttcaaaaggattatggagcactcaccagtacccatgagcccattggagagtctagcttcttctgctgttagaacagccaactcggctagagcagctcttatcttggttttaactagaggagggagtactgcaaaattggtggctaaatacaggccaggcatgccaattctttctgtggttgttcccgagcttaagaccgatacctttgactgggcatgcagtgatgaggcccctgcaagacatagccttatattccgcgggttggttcccgtattgagtgcagcttctgctagagcttctcatgctgaaacaactgaagaagcaatagaattcgccatgcaacatgccaagtccaagggtctctgccacaacggggattcggttgtggcacttcatcgtgtgggcactgcttctgtcatcaagatcttgactgtgaaatgatcaccccattacagggaattcttctgctgtttttggcaaattttttagatggtgcaaaagaggtctcgttatacctcttcatatctacattggatgcaaacttcaatcaaaagcatttatcaggatgggttacctgtttttcacatatcttatattactgttttttttttttttttgttacatttgccttatcattgtggcgagcagccacctgctttcatttgttaagattttgtatgaggcttttggtgaaccaaaaaactagccacttctggattttgaattctacggtctaaagttgtttt

SEQ ID NO: 8119 - DNA, 1337 bp, Glycine max
gaaaattgatacggattcctgggaatttgccaatgaaaactttgttaggggtcaaaagcatttgttgaagaatatacatagaaggaaacatccacacagtgcagatcagcaaaaggcattgccacagcaagacaattgtgatgaaccatcccaagaagcaccaaatcatggcctttggaaagaagttgagaatctaaaacttgataaaaattcgctcacacaggaattggtcaaacttaggcaacatcaggaatctgctgagagtaagttgctgctcctgagtgatcgccttcaaggaatggaaaagcatcagcagcagatgttgtcattcttagtcatggttgtgcaaagccctgggttcatggttcagcttcttcatcctaaggaaaataattggcgtttggctgaatcatggaatagattggatcaagataaacaagatgacaagccagttgcttctgatgggatgataataaagtataaaccacctgtaggtgaaaaactaaagcccgtagttcctctatctcctggtttcgaaaatcaaccagaacctgagctttctgctgatgggctgaaagacttgtgcatcagttctgaattcttgaaagtacttctggatgaaaaattgtctccgttagaaaatcattctccatttctcctaccagatttacctgatgatggttcatgggaacagctttttcttggcagtcctttcctgggaaacattcaagattctaagaatgaaagtgaggggcacaccaacagtggaatggagatggaaccaacaatatctgagactccaaatgaaaattctcgaacttttgaatcgatgatcgtagagatggagaaaactcgagaataagttggagttgtatgcacatggtgggctgtcttcataaaataatatccatcaaatatttttcatatgggctgtctcatactgagctaatggagctttagattctgaaactaacaacatatagggaaggaagtaataatgttcatcagatatttttcagctgagctgtcttcacatattacttcaacactataattatatcatagtattaagtcgcaattattttctctcccatcttccttcagcagttgttagatcctcatctaaaatccttattttggcatcttgatacatggtgtcggagaccaggagtcgtatgttagtgcactagtgcggctacctatatataatggatcaaatatttcttatttggagaactgcaagggaaaacggcaactttattttttgtgccacattaaacagtggcacttgccttcatatatattataaaatttcataaaattcatgcttcgtttgc

SEQ ID NO: 8120 - DNA, 1205 bp, Glycine max
gtcgttgtgcaggtaccttcatgctccaactacttccccttgcttcctcgtcattatcatcatctgtaatttcgtattagcgtacactacacacactcctcttcctagctgccttcacagcaaaatactggttgaaacctcttttgccttgtctagaggaggaagtggttagagttgggaacgctactacttctgagatgcgtgttggatcaacggctaattgttgttacctgcagctggaagctcctcaacagaataatgtaaccgagtcatcatcagatatgtcagatcggatgatcaagatccagatcgcaaatcaccctctttatccagatttactctctgcatatatagaatgccaaaaggttggagcaccgccggaactggcatgccttcttgaagaaataggccgagaaagccaccgcatgaatgctcgccgtgagattgtggagggtcctgaacttgaccacttcatggaaacattctgcgaagttcttcatagatacaaggaggagttgtccaggcccttcaatgaagcgacgttatttttgggtgacatggaatcacaactcagcaacctttgtaatggaacactaacaaagtcatcggataacaacaaccgctccgatgaggtagctagtggggcatcagaagaggaattaagttgtggggagatggaagcatttgaagatcatgtatcttcttctgtaacttgcccaagtgatcaaaggcttaaagaaatgctccttcgcaaatacagcggccattttagcggtttgagaaaggaatttctaaaacgaagaaaaaagggtaagctaccaaaggatgcaaggatagcactcatggactggtggaacacccattatagatggccttatcctacggaagaggagaaagtgaagttgtcagaaattactggactggatcaaaagcagatcaataattggttcatcaatcagagaaaacgtcattggaaaccaactgatgacatgcgatctgccgttatggacggcataagaggacctatgttgttttaattctggaaagtggtcctcaacgatctgattctgaacttggaatctttgcaattgcaggagtaatgtatatgtattgcattccctgttatacatgatatactaaattttggagtctgaactgatgattgccaggtgcgtttggctaatatacttatcaaatttgtagct

SEQ ID NO: 8121 - DNA, 988 bp, Zea mays
gttccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcgcaaccaggcggtggtggacgagaacgtggagaagctcaagaaggtgctggaggtgtacgaggcgcggctggccacgtgcacgtacctcgccggcgacttcctcagcctcgccgacctcagccccttcaccatcatgcactgcctcatggccaccgagtacgccgctctcgtccatgcgctcccgcacgtcagcgcctggtggcagggcctcgccgcgcgcccggcggccaacaaggtggcgcagttcatgccggtcggcgccggagcgcccaaggaacaggagtgacgatgaagcgatcgaagcgacttgtgttgttgtgcttgattagttaattggaaaccttctcactcatctagtccatcatggtgcctgcttttctttatactatttgtcttaattttgctgctttctccacggaataatagtagagatttggaaatgtaatgtattttatcaaaatatattggattttcaagcaatatagtatggttttcgctgc

SEQ ID NO: 8122 - DNA, 1108 bp, Zea mays
ctagcatccgcagttcccccgcgcccgagacgcaaccccgcgccaggagtaagtttgttcttttatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaagggacagtaatcttgggagagcgcatattgttcgagcccattgttttagatgctctatgctgtcgaagctgaagctgtgccgtgctattattgtagctgatttcctgttccctcactttttttttatattagtaggctggtagtgttcgaattagttccccattgctttgtgttgccgctagctgtcactaagtccgtgtggactggtattattcactggatttgagaagcatgtcagtggttgctctagcgttttattgagttttg

SEQ ID NO: 8123 - DNA, 829 bp, Zea mays
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgc

SEQ ID NO: 8124 - DNA, 767 bp, Zea mays
ctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggccttaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttactctgattccatctcgcacattatacaacaacaacaattaccattcatgttcagccccacagccatggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctcattat

SEQ ID NO: 8125 - DNA, 804 bp, Zea mays
ggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaagg

SEQ ID NO: 8126 - DNA, 790 bp, Zea mays
gttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgc

SEQ ID NO: 8127 - DNA, 1123 bp, Zea mays
cgttcccaccgcaagcaaagcattttcagccgccccaccgcagcagcagagaagaggccgccgccgccgcgaccaagagccgatggatccgaagatgacagaggtgacccagatgttcgcccgcttcaaggcggcctacacccgcaacgacctcgacgcctgcgtcaccctcctctcacagctcaaggtccatctcaccaaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagagatgagatcgctgggtgcagcgaaaaggggtatgattccctatctgtaagtgatgcaaaacaaatgcttatgttcagttctgaccaagatctgcacgagtacatcacagaggagcacccggaatgggagcttaagaacggtgccgtcttcttccagaaggcaaaggagtcacagccctacaaggagatcccatccttgcagctcatcaaccagacgctcagctatgcgagggagctggagcgtattgtatgatttaatttcacagtaatccctggttgatgtttatttctgtggtcacttggcatggcatgtactgtcctttacatttgagatcagctctgatcgcagctcatgtcagctctgatcaatctctgaagggcttgatctctgcggcattgtttcaccacattaactgcattgcttgaaagatgcctgtcatccattgctgctgttaacttttgatgggcttaatattgaattattacatcg

SEQ ID NO: 8128 - DNA, 790 bp, Zea mays
tcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaagg

SEQ ID NO: 8129 - DNA, 825 bp, Zea mays
ggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgc

SEQ ID NO: 8130 - DNA, 815 bp, Zea mays
tagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttct

SEQ ID NO: 8131 - DNA, 826 bp, Zea mays
ttgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaattgctgccattcaaccaacttgctttgacaaacccaacaacgttctaccaacaacccatcattggcggtgccctcttttagattgcttatgagttatagttcaataatgaagttttttggatgatgtttgtggcttcccagaaataagaaagtacatttct

SEQ ID NO: 8132 - DNA, 816 bp, Zea mays
tgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatcc

SEQ ID NO: 8133 - DNA, 1715 bp, Zea mays
ctccaagcccagctacttcccggcgatgaccaagatcgtcggcactctcggccccaagtcgcgctccgtcgacacgatctccgcctgcctcaaggccggcatgtccgtcgcccggttcgatttctcgtggggggacgccgcgtaccaccaggagacgctggagaacctcaagctctccatcaagtccaccaagaagctctgcgctgtcatgctcgacaccgtgggcccggagctgcaggtggtgaacaagagcgagaccccgatctccctcgaggagaatggcacggtcgttctcacccctcaccggggccaagacgcctcctccagcttgctgcccatcaacttctctggactcgccaaggcggtgacaccaggggcaacaatattcgtgggacaatacttgttcactggcagtgagaccacctcagtttggttggaggtttctgaagtgaaaggagatgatgtggtgtgtataatcaagaacacagccaccttggctgggtcactgttcacgctgcattgctcccagattcacattgacttgcccaccctgtctgatgaggataaggatgtcattagaaaatggggtactcccaataagattgacttcctttctctgtcctacacaagacatgcagaggatgtgcgccaggcacgggaattcctgtcaaaattgggcgatctaagccagactctgatttttgccaaaattgagaatgtcgagggcctgaaccaatttgatgaaatactggctgaggcagatggtatcattttatcaagagggaacctgggaattgatcttccacctgagaaggtctttttgtttcaaaaatctgctcttcacaagtgcaacatggctggaaagcctgctgttgtcactcgtgttgtggacagtatgactgacaacctcaggcctactcgggcggaggcaactgatgtggccaatgcagtacttgacgggagtgatgccattctccttggtgctgagactcttcgaggtttatatccagttgagactatttcgacagtgggcagaatttgtgctgaggctgagaaggtattcaaccaagatttatacttcaagcaaactgtgaaatatgtcggagaacccatgacccacttggagtccattgcttcctcagcggtgcgagctgctatcaaagttaaggcttcggtgatcatttgcttcacctcttctgggagggctgcaaggctcatcgccaagtacaggcccaccatgcctgttctttctgttgtcattcctcgtctgaagacaaaccaactgagatggagtttcactggtgcttttgaggcaagacagtcgctgatagttagaggcctctttccgatgcttgctgatcctcggcatccagccgaatcaaccagtaatacaaatgagtcagttctgaaggttgctctagaccatggcaaggcatgtggtgtgatcaagtcccatgaccgtgttgtcgtttgccagaaggtgggagattcatcggttgtgaagatcattgagctggacgactagggcatactttgccgattttttttttgacgaggccggaatttgttggctatatgtataatcctatagctttctttacaaatgagcagtttttccctatggtgccatcataggacttgcttagcgatttaaaactcgattatgtgccacctaaaatgggcagatggaacaatgaaatcatactgtgcccttt

SEQ ID NO: 8134 - DNA, 822 bp, Zea mays
acgcgtgggctcctcctctcctcccccacccgtccatcgcccctccctccggtctgcgctcccacagcctcacccctgtgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttaagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaatgtaccgtggttgtgaaccggtcaatgtgatctgaaataatgtggtataggggcaaataatgctctgtttggcatt

SEQ ID NO: 8135 - DNA, 1056 bp, Zea mays
cacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggacatgttttttctgagttctacacctgcttgtcttgcttatgtgacggtggagtattgtgcctttaatatcaacctaatcatggactggttcatc

SEQ ID NO: 8136 - DNA, 767 bp, Zea mays
gggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8137 - DNA, 823 bp, Zea mays
ttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8138 - DNA, 949 bp, Zea mays
acgttgccttcgcgtacacctactccatgcttctcatagaaatccaggacactgtgaaggcaccgccatcagagaacgtgacgatgaagagggccagcttctacggcatcagcgtgacgaccatcttctacgtctcgctcgggtgcatcggctacgcggccttcggcaacgccgcgccggggaacgtgcttaccggcttcgacgagccgttctggctcgtcgacgtcgccaacatcgccgtggtcgtccacttggttggggcatatcaggtgtacgcgcagccgatcttcgcgtgctacgagaagtggctggggtcccggtggccggactcggccttcttccaccacgagtacgcggtgcgcctgcccggctgcgcggtgcggttcacgatgtgcaagctggtgctgcgcacggcgttcgtggccgccacgacggtggtgtcgctgatgctgcccttcttcaacgccgtgctcgggctgctgggcgccatcgccttctggccgctgacggtgtacttcccggtgaccatgtacatcgcgcaggccaaggtggcgcccggcagccgcaagtgggtggcgctgcaggcgctcaatgtgggcgcgctcctggtttcgctgctcgccgccgtgggctccgtggccgacatggtgcagcgcctgggccatgtcaccatctttcagacgcagctctgaaacaagtattcagatcttatgcatgggaacgcgcttgcagaggcatacatcatacacatgcttgtgccgtatattcacctgtgatcttagtacattggttttggaagaacaactaaaaatggagcatgtaagtcattccacctagatttcgtgcattgcaagagtgctttttggggtgaaatagcagacagtgcacactccatgacacatttgaagcccagctaagcgttgggctgaattaatgattatgtttcttc

SEQ ID NO: 8139 - DNA, 824 bp, Zea mays
gttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8140 - DNA, 1669 bp, Zea mays
ctgctccggtcgctgctgaacgccgatctgattggcttccacacttttgattatgccagacacttcttgtcgtgctgcagcaggatgctcgggctcaagtatgagtcgcagaggggctacattgctctggagtactatggccggacagttactatcaagatcttgcctgtgggagtacacttggagcagctacggtcagtcctcaacctcccggagcttggggtcaaggtggccgagcttctgaaacagttctgtcatcggaaccgtctgctgttgcttggtgttgatgacatggatatcttcaaaggaattagcttgaagcttttggcgtttgagcagctcctaatgcagcatccggagtggcggggaagggtggtgcttgttcagatcgccaatccagcaagggggcggggaaaggatgtgagggaggtacaggaagagagcgatgcaatggtgaggcgcatcaacgacgcgttcgggcagccaggttaccagccggtgatactgatcgaccagcctctgcagttctatgagaggatggcttactatgtcgtcgcggagtgctgtttggtcactgcagtgagggacgggatgaacctgatcccatacgagtacgtaattgctcgacaagggaatgagaggatagatagtattctaggccttggtccggcttcaaggaagaagagcatgcttgtcgtgtcagagttcatcggctgctcgccctccctgagcggcgctatccgtgtgaacccttggaacatcgattcagtagccgacgcaatggactacgcgctggagatgccggaaggggagaaggtgttgagacatgagaaacaccacagatacgtgagcacgcacgacgtcgggtactgggcgaacagcttcctgcaagatcttgagcggatttgcctcgaccataacaggaggcgttgctggggcatagggtttgggctgaagttcagggttgtggccctcgacccaaacttcaagaagcttgcggtggagcacttggtcttggcctaccggaggacgaagaagcgtgtcattctcttagactacgatgggacgctgatgccgcagacttcgctcggtaagagtcctacctcaaggacgatagacatgttgaacagcctttgccgcgacaggaacaacatggtcttccttgtgagcgcaaagagccggatgactctgaacgaatggttcttaccatgtgagagccttggactagcagctgaacacggctgcttcctcaggctgagaagagacgcagaatgggagacatgcgttccggtgatagactgcagctggaagcagatcgcagagcctgtgatgaagacctataccgagactacggacgggtcgactattgaggacaaggagactgccatcgtgtggtgctacgaggacgccgatccagatttcggatcctgccaggccaaggagctccacgaccatctggagagcgtgcttgcaaacgagccggtctcagtgaaagctggacccaacctcgtcgaggtgaagccacagggcgtaagcaagggcctggtggcgaagcggatcctgtcgacgacgcaggagcggggcgacgccgacgacgacctgccggacttcgtgctgtgcgtgggcgacgaccggtccgacgaggacatgttcgaggtgatcgcggcgg

SEQ ID NO: 8141 - DNA, 1803 bp, Zea mays
ccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaat

SEQ ID NO: 8142 - DNA, 1760 bp, Zea mays
agaggcagcgcagggtgcaagaagctgtccctccctccctcccctgtgcttctgctagctaggtgcctgcggaggagagatagggatacgatggccggcggtggcatcgtgaacacgggcggtggcaaggactaccccggcaagctcaccctcttcgtgttgctcacctgcatcgtcgccgccaccggcggtctcatcttcggatatgacatcggtatctcaggcggcgtgacgtccatgaacccgttcctggagaagttcttcccggaggtgtaccggaagaagcaggaggccaagacgaaccagtactgcaagtacgacaaccagctgctgcagaccttcacctcctccctctacctggccgcgctggtcgcctccttcttcgccgccaccgtcacccgcgccgtcggccgcaagtggtccatgctcgtcggcggcctcaccttcctcgtcggcgccgccctcaacggcgccgcccagaacatcgccatgctcatcgtcggacgcatccttctcggagtcggcgtcggcttcgcaaatcagtccgtgcctgtgtacctgtcggagatggcgccggcgcgtctccggggcatgctcaacatcggcttccagctgatgatcaccatcggcatcctggctgcggagctcatcaactacggcaccaacaagatcaaggccgggtacgggtggcgcgtgagcctggcgctggcggcggtgccggcggccatcatcaccctgggctccctcttcctcccggacacccccaactcgctgctggagcggggccacccggaggaggcacgccgcatgctccgccgcatccgcggcacggacgacatcggcgaggagtacgcggacctggtggcggccagcgaggaggcccgccaggtgcgccacccgtggcggaacatcctgcgccgccggtaccgcgcgcagctcaccatggccgtcgcgatccccttcttccagcagctcacggggatcaacgtcatcatgttctacgcgcccgtgctgttcgacacgctgggattcaagaacgacgcctccctcatgtcctccgtcatcacgggcctcgtcaacgtcttcgccaccgtcgtgtccatcgtcaccgtcgaccgcgtcggccgccgcaagctgttcctccagggcggcgcgcagatgatcgtgtgccagctcatcgtgggcacgctcatcgccgccaagttcgggaccagcggcacgggggacatcgccaagggctacgccgcggtcgtcgtggtcttcatctgcgcctacgtcgccggcttcgcctggtcgtgggggcccctgggctggctcgtgccgtccgagatcttcccgctggagatccgcccggcggggcagagcatcaacgtctccgtcaacatgttcttcaccttctgcatcgcgcaggccttcctcaccatgctctgccacttcaagttcggcctcttctacttcttcgccggctgggtcgtcatcatgaccgtcttcatcgccttcttcctgcccgagaccaagaacgtgcccatcgaggagatggtgcttgtctggaagtcacactggttctggaaaaggttcatcgccgacgaggacgtgcacgtcggcattggcaacaaccacccggccaaaaacggcagcgacaccaagggggccgacgcgtgaacgtgatctcaacatctatattccatctacagtcacaactgaaatgtacatttaggcttccattgttccatcaactagtagctacatgtcctcctagt

SEQ ID NO: 8143 - DNA, 1324 bp, Zea mays
ctcagcttgcaggttgcagccgatgagaatcgagcgtgatctccacatggccacaggggacggagaaactagctacacgaaaaattctaggattcaagagaaaactatgtttcagatcaagcctgtccttgaggaggccacaagagcagtatacacagctctccaccctcaaaccatggttgttgctgacttaggctgctcatctgggcctaacacactacgcttcgtatccgaggtgattggcatcatagctcgccattgcaaagaatatggccgacaacatgaccacacacagcttcagttcttcctgaatgacctgcccggaaacgacttcaacaatctcttccagctgatccagcagttcaataagtcgacggcaataaaccacaagagtgaggcagttgaggcactacctcctccgtgctatatctctgggttgcctggctcctactacactaggatcttccctagcgaaagtgttcaccttttccattctttgttctgccttcagtggcgctctgaggcaccagagggcaacaaaaaaacatgcctagatatctacatcacaaagactatgtcaccgtcgatggtgaagttgtttcaacaacagtttcagaaggatttctccctcttcctcaggctacgctacgaggaactcgtgtccggtggccaaatggttctaacatttattggaaggaagcatgagaatgtgttcactggagagtctaaccatctttacggattgcttgcgcagtcactgaaatccctagttgatgagggtcttgtggagaaggaaaaacttgaatcattctatttaccaatgtattcaccatcggttggtgaagtggaggccatactaaagcaagttgggttgttcaacatgaatcatgtaaaagtattccagacaaattgggatccctacgatgacttggaaagtgatgttgtgcataacagtattaggagcggtgaaaatgttgctaagtgcctacgagcagttatgcagccgctagtcgcaagccaatttggagaacccattctcgataagttattcaaagagtacgctcgccgtgttgccaaacaccttgagaatgagaaaaccaagcatgctattattgtcctatccatcgagaaagcaattcacctgtgaagtgtattgtttctcactatctcgcttggcatgctactatttgtgtagaaaactttgtatgtatgtttttttgtgtgtttgtgtcactagtgtattgaattacatatggtgtttttgttgttttatttatcacttctcctgtattcctatattttatatgtctaagtttttaaggtg

SEQ ID NO: 8144 - DNA, 2680 bp, Zea mays
ttccacgaacgttggcgcgcaagctcgtggtgtgagcggtcactgtctcccatcccatggctccggcgctgagcgggactctgggcgcgtcgtcggtggcggcgctgcggccctgcgcggggaggagggcgccgtccgccgcgagctcggttgcgccgcgcgggagcggggtggtgaggtgctccagagggctcaggtgggacgcccacagaagcagggggaggttgctcagggtgaggtgcgatgcggccgtcgcggagaagcccgccgaggaggaggcggctggggagaagttcgagtaccaggcggaggtgagccgcttaatggacttgatcgtccatagtctgtacagtcataaggaggtatttctccgggagcttgttagcaatgcgagtgatgcgctggataagctgaggttcctcggcgtcactgattcttctttgcttgctgatggcggcgagctagaaataagaattaagcctgaccttgatgctggaacgattactatcactgacactggtgttggtatgactaaagatgagctcaaggactgccttggtaccattgctcagagtggcacctcaaaatttctgaaggccctcaaggaaaacaaagaccttggggcggacaatggtctaattggtcagtttggtgttggattttactcagcttttcttgttgcagagaaggttgtggtgtccaccaagagcccaaaatcagataaacagtatgtgtgggaagctgtggctgacagtagctcttatgtcataaaggaagagactgatcctgagaaaatgcttactcgtggaactcagattaccctgtttctaagacctgatgataagtacgagtttgcggacccttcaaggattcaaggcttagtaaaaaattactctcagtttgtgtctttccccatatacacatggcaggagaaatcaagaactgttgaggttgaagaggatgaagagccgaaagaagttgaagaggcaacgaagggtgagaaaaagaagaagactattacagagaaatattgggattgggaactagccaatgagacaaaacccatatggatgagaaatccaaaggaaattgagaacaccgaatacaatgagttctataagaagacattcaatgagtttttggaccctcttgcccacactcacttcacaactgagggtgaggtggaattcaggagtgttctttatgttccaggcatggcgcctcttagtaatgaggagataatgaaccccaagaccaaaaatatccggctatatgtcaaaagagtcttcatctctgatgactttgatggtgaactgtgtgcatattgcagtttccaagatacttgagctttgtgaaaggtgtggtggattcaaatgaccttcccctcaatgtttctcgggagattcttcaagaaagtcgaattgtaagaattatgcgcaagcgacttgtcagaaagacctttgatatgattgaagagattgcggaaaaggaagataaggaggactataagaagttttgggagagctttggcaagtttgtcaagcttggttgcatcgaggacacagggaatcacaagcgccttgctccattgttgcgcttccactcttctaaaaacgagggagatttgataagtcttgatcaatatgtagagagcatgcctgaaagtcaaaaggcaatctactacatcgctacagatagtctccagagtgcaaagactgctcctttcctggaaaagctggtccagaaagatattgaagttctctaccttattgagccgatagatgaggttgccattcagaacttgcagacctacaaagagaagaaatttgtggatatcagcaaagaggatctggaattgggtgatgaagaagaagagactaaagaaaccaaacaggagttcactctcctatgtgattgggttaaacaacagcttggcgacaaggttgcgaaggtccaaatatcaaagcgtttaagttcatctccatgtgttctcgtatctggcaagttcggttggtccgccaatatggaaaggctcatgaaggctcaaacacttggtgacacatcaagtttggaattcatgaggggaagaaggatctttgaaatcaaccctgaccacccaattatcaaggatttgagcgctgcttgcaaaaatgagcccgaaagcacagaagccaggagggctgttgagctcctatacgaggctgctttaatctcgagtggatatactccggagagtccagcggagttgggtggcaagatctatgagatgatggcgattgccctcggcgggagatggggaaggtccgacatggaggaggccgaagcgtcgacgggtgaggccagcgcagaggcagactcatctgaagtcaccgtagcagaggtgattgagccctcggaagttagacccgagagcgatccgtggagggaccagtgagttctcccacgggcatccttaactccatatttagcagtgccggggataaaaactaagccatgggcaagaacatattgccgtggcaatttttttgtaggcttagactttgccggccaccagaatcttattgaggaggtagtggccttagaaaagaataataaagcatgaagactgatgattacatagcgaaattgtgctgtccctctcaataatatttataatgaaaagaacttatttctgcaactt

SEQ ID NO: 8145 - DNA, 2372 bp, Zea mays
gccattccacgctctcgcggctcgtgtgccagcggtgaccagcgctcgtgctcgtccagtccaccaggcgctgctgttccggcaagccagccagcagcagccgccgccgccgccgtctcggagctcgagctcctagtcccccggggccgaggcgccggcgccatggaccagctccggcccgagccggccgcgggcgcgcacgagatcgagaagacggcggcgccggacgtggagtcggagcccgcggcggcggtgccggagccggagcgcgtgccgccgtggcgcgagcaggtcaccgcgcgcgggatggtggcggcgctgctcatcggcttcgtctacacggtgatcgtcatgaagctgagcctcaccacggggctcacccccaccatgaacgtctccgccgcgctgctcgccttcctggcgctccgcggatggacgcgcgccctcggccgcctaggcattgcatgccgccccttcacccgccaggagaacaccgtcgtgcagacctgcgtcgtcgcctgctacaccatagggttcggcggtgggttcgggtcgttcctgctgggcctggacaagaagacgtacgagctctccggggtgagcacgccgggcaacgtgccggggagctacagggagcctgccatcggctggatgaccggattcctcctcgccgtcagcttcgtggggctcctcaccttgcttccactcagaaaggtgctcgtcatcgactacaaactcacttatccaagtggaacagccaccgcggttctcataaacggattccacacacctcaaggagataagaatgcaaaaattcaggtccgtggattcctcaagtacttcgggatcagcttcctgtggagcttcttccagtggttctacaccgccggcgaccactgcggattcgcccagttccctactttcgggctccaggcttttaaccagacgttttccttcgacttcagcctgacgtacgttggtgctgggatgatctgctcgcacctcgtcaacctctcgttgctgttcggtgccgtcgtttcctggggcgtcatgtggccactcatcggcaagcagaagggcaactggtatccggcagatgcatctcagaatagcatgacaggcatctacgggtacaaggccttcctttgcattgcccttctcgtgggagacggtctctacaacttcgtcaaagtcatagctatcactgtcaagaacatacgcgagagatcacgtcgcaagaacctgaacagagtggcggacgcggacacgatggcgctggacgacatgcagcgcgacgaggtgttcaacagggacaacatcccgacgtggctgtcctacgcggggtacgcggcgctgagcctgatcgcggtgatcgccatcccgatcatgttccgggaggtgaggtggtactacgtggtggtggcgtacgcgctggcgccggcgctggggttctgcaacgcgtacgggaccgggctgacggacatgaacatggggtacaactacgggaaggtcgcgctgttcgtgctggcggcgtgggcggggaaggacagcggcgtggtggccgggctggtggggtgcgggctggtgaagcagctggtgctcgtgtcggccgacctgatgcacgacttcaagacggggcacctgacgctgacgtcgccgcggtcgatgctggtggggcaggccgtgggcacgctgatggggtgcgtcctggcgccgctcaccttcatgctcttctacagggcgttcgacgtgggcgagccggacgggtactggaaggccccctacgcgctcatctaccgcaacatggccatcctcggcgtggagggcttctcggcgctgcccaggcactgcctgcagctgtgcgcggggttcttcgcgttcgcggtgctggcgaacctggcgcgggacctgctgccgcgccggctcgcgcggctcgtgccgctgcccatggccatggccgtgccgttcctcgtgggcgccagcttcgccgtcgacatgtgcgtggggagcctcgtggtgttcgcgtggcacaagctcgacggcaagaaggccgcgctgctggtgccggccgtcgcctcggggctcatctgcggcgacgggatctggacgttcccgtcgtctctgctcgcgctggccaaggtcaagccgcccatctgcatgaagttcacgccagggagctagagggcgcgctgacgatgcgtacagaacagagggcatcgttcgtcgtttgtggggtggaatccgtgtagtagaattacataccaaccaggcctgttctaatgtccatatgagcttaatgtacggtgtatatatatgtaaaaatggaaatctgaaggatgacaggatgaattgcctgttgtctagtagcacgc

SEQ ID NO: 8146 - DNA, 965 bp, Zea mays
tccgatcctccacaccagcacccgccgccgccgcctcttcccttgcgcacctgctgctgtgcggatcggtgaggcggaggagtaggatggcgagcgcggccggaggcggagcggcgggggaaggggagtggcttaaggtatcccagctcaggcccatggtggaagcgcaggaccccaacgccaaggcagtggacaacctgacgctgcgtcggttcctgcgcgcgcgcgaccacgacgtggacaaggcctccgccatgttcctcaagttcctcaagtggcggagggaggcggcgcccggcggctccgtgccggaggagcaggtgaggagggagctgtcgcaggacaagctgtgcatgggcggcgtcgacagggccggccgccccatcctcgtcgccttcgcggccaggcacttctccgccggccgtgacatggcagagttcaagagttttgttgtctacttcttcgacaagatctgtgccagaatccccagagggcaggagaaattcctctgcatcgttgatctcaagggctgggggtactcaaactgtgacgtccgggcatacattgccgctatagagatcttgcagaactactacccggagcggctcggcaaggcgctgatgatccacgtgccctacatcttcatgaaggcgtggaagatgatctaccccttcatcgacaccaacaccagggacaagttcgtgttcgtggaggacaagagcctgcaggagacgctgcggcgggagatcgacgaggggcagctcccggagttcctcggcggcaagatggacgtgatcccactcaaggactatggcgtgcagcagcagcctcaggccgtgtaatagccatgccatgcgtagcatacacgagttgtggctaggagcatagcatggcaataactgtgtagctgctgtgaaagtgaaaatgaaacgttgcgctgtttagccgggtcaattgaccagccc

SEQ ID NO: 8147 - DNA, 1224 bp, Zea mays
gggcgccgccgccgcaagccgtccgccttgcccttcacgaaggcttggtcctcctccttgtatctccactccccccttcacagatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctcctgctcgtgttggtctggttgctccagttgatgttgttgtgccccctggcaacactgggctggatccgtcccagacctctttcttccaggtgcttaacatccccaccaagattaacaagggtaccgtggaaattatcacccctgtggagctgatcaagaagggtgaaaaggtgggctcgtccgagtctgccctgctcgccaagctgggtatccgccccttctcgtacggcctccaggtcaccagtgtctacgaggatgggtccgtgttcagccctgaggtgctcgacctttctgaggaggacctgattgagaagtttgccactggtgtctccatggttgcctccctgtcactggcgatctcgtacccgacccttgctgctgtgccccacatgttcatcaatgggtacaagaatgtgcttgctgttgctgtcgagacagactactcatacccacatgctgacaagatcaaggagtacctcaaggacccaagcaagtttgctgttgccgccccggttgctgctggggactctggcgctgcagctgctcccaaggaagaagagaaggctgcggagcctgaagaggagtcggacgaggaaatgggcttcagcctcttcgacgactagagctgctgttttcgtcaaactgctgcaagttttggctttttttatcatctacaagtactgtttcctatattttttagcagacaaattatcgtgtgtaatcgacaatgatatctccttaaattttaagtacctgtgttgtgtc

SEQ ID NO: 8148 - DNA, 1005 bp, Zea mays; identical to SEQ ID NO: 2490

SEQ ID NO: 8149 - DNA, 1284 bp, Zea mays
tcgcagcgtgtctcgtgctccccccaggctcctcttcctcgctttccctccaccccgggcgcaaaccctaaccctaccgtcgctcgccccgcggcgtctgccaatggcgcgccccgtgtgagtgtgcgcgagagaggggtagaccttgaggccgctacccggggaggagagcgagagatgtataaacaggggggagcggggggaggggctgggctggaccggaagcggatcaacgacgcgctggataagcatctcgagaaggcggtcgcgtcgccgtccacgtcgagggggtcggcgggcggcgggcgcgaccaccaccgcctcgtcgtgccgtcctccgtgtcgtccatccccaagggccgctgctccgaaggggagtctgattctgatagtgaagcatcggatgttagcggctctgatggagaagacacctcatggatttcatggtattgcaacttaagagggaatgagttcttctgtgaagtcgacgatgattatattcaagacgacttcaacctttgtggtctcagcagccaagttccttattatgattatgctctcgatctcattttagatatcgagtcatctcatggtgatatgttcactgaggaacaaaatgagctcgtagaatcagctgcagagatgctttatggtctgatacatgcacgatacattctgaccagtaaaggactggctgcaatgctggagaagtataagaactatgactttgggcggtgcccgcgtgtttactgctgtggtcaaccatgcctgccagttggacaatcagacatccatcgatctagtaccgtgaagatatactgccccaagtgtgaagacatctactacccacggtccaagtaccaagacatcgacggcgcatactttgggacaacgttccctcatctgttcctgatgacatacgagcacctcaagccacagaagctctcgcagcgctatgttcctcgtgtctttggcttcaagctccacaagccatgaacctcatgtatttgtcttttaaactcctcaagacgtggcactgggggcatgcgggagttttgcaatccttgaagacttgcatataagagcgccattggcaggtcagtggattggtaaaattctatcatgctgcagcgtgcttgtaccttagctggctggcacctatccaacatttgaatgtagctctaaggatatcaatgttgtaacctaactgctattgttctttgattagtaaaccaggagccccccctacaatgtagaatatggcaattatttatggctttgcag

SEQ ID NO: 8150 - DNA, 2004 bp, Zea mays
acatgagttcccgttttgctcccgagttctctctcacgtccatccctctctctcgtctcgttctttagcagggccggctggagcgcccactcctccctccagcccggccccagccgcgccgccgcgccggtcgtagacccaacgcccgccgcccagcccagcgcgccctccggccgtgaggcggagaggatcgggcgggcctcggggcgagcgccacgcgtagacggcggttgaggagcctgagaaaacaacggtcctccttcaagatcctgatccctacgcgcaggcgtaggagattgtattccgtctgattaatcggcggagagcaagcgggtgttgcggctgcgcgagcatggcgggcgaggaggctgcggagggcagcggaaccaggaggcacatggatctaaacctgtatctcggcctccctccattgccgcggcctccagtctggctggacccgacgttgatgcccaacttgaccggtgctgcgccagaatcctcaataactggtgagcctgaggaatcgttggccctgggggcggcagcctattctccgtcgaatgcactttccaccccggaggagcacccaatgcttgatcccatagtttattcctggctcgacggcaacaggaccgatggtgaagaggacactgatgctcctgagccggggccagtggatggtgccaatgtctctaggtcgcagcttgtggtagctgccacaggattggaaggggatgatgatcttcctctagtaaggtttgtgcgccctagccagatggttgttgctggtggaatggagacggtgaacacaagtatacttcagcagtccattcaaagggctgctgcaattgaggccaggactcctgaactccgctttcagagggtgatacagattagccagcagcatagaattgtgaggccagcatcagtgaaccgcagtcaaggggcagctagtacagatgcggataggcttgtctgggcaatccagcgcactcataactctttagaagcaacaaggcggcaaaaactagatgacaacaacttgtgtggaaacggttctgctaagaaggatgagtcctgtgactgcaactccagctttgagtgcaatatctgtcttgacccagctaaacagcctgtggttacaccctgcggtcacctcttctgttggccatgcttgtaccagtggcttcatgcacattcaccccactctgagtgccctgtatgcaagggtgaggtgctagaactgaatgtcactccgatatatggaagaggcggtgaagaagggaattccaccaaccctgacttcccacctaggccacgagcaaacagaagggagagcctgaggcaacagctgcaaatgacagacacaagaggaattgcaacagtggtgaggcagttgatacaaaaccagggtataattagcgttctcccaagcccaacagggatcgagatgtcggtggttcctgcaggccggcaaagggctagggctcggagacagcaaaggcaggataataatgcatcatcttccatacacgttgtagcgcagaatatgggcaatgttgcccctgagagcagcaaccaaatccagttgtcacattctaacggtgacaatgctgcacagatggttcttgcagctcctcagcagtcatcatctgtcgaacagctgtcaacttctagcaccacagctgttatattgggcgagcctgggtcaagtaggcggtcaaggccttcggagtctccaaccataagaagaacgaggaggaggccacagtaggtactcgagtgttgtcactcccttcagtaaaatctacagaccatgccccagtgatagttattaccatgattatctccaataacatctcaaggttaataatgtagaaatgtatatgccatcactggtttctgcctttctcttacattccatgtatcatctattatgcaaaacgagtcgaaatatcagttccagtatctatgataatcttgacctttgtatactgggaatat

SEQ ID NO: 8151 - DNA, 1391 bp, Zea mays
gcctcagcttgcaggttgcagccgatgagaatcgagcgtgatctccacatggccacaggggacggagaaactagctacacgaaaaattctaggattcaagagaaaactatgtttcagatcaagcctgtccttgaggaggccacaagagcagtatacacagctctccaccctcaaaccatggttgttgctgacttaggctgctcatctgggcctaacacattacgcttcgtatccgaggtgattggcatcatagctcgccattgcaaagaacatggccgacaacatgaccacccacagcttcagttcttcctgaatgacctgcccggaaacgacttcaacaatctcttccagctgatccagcagttcaataagccgacggcaataaaccacaagagtgaggcagccgaggcactgcctcctccgtgctatatctctgggttgcctggctcctactacactaggatcttccctagcgaaagtgttcaccttttccattctttgttctgccttcagtggcgctctgaggcaccagagggcaacaaaaaaacatgcctagatatctacatcacaaagactatgtcaccgtcgatggtgaagttgtttcaacaacagtttcagaaggatttctccctcttcctcaggctacgctatgaggaactcgtgtccggtggccaaatggttctaacatttattggaaggaagcatgaggatgtgttcactggagagtctaaccatctttacggattgcttgcgcagtcactgaaatccctagttgatgagggtcttgtggagaaggaaaaacttgaatcattctatttaccaatgtattcaccatcggttggtgaagtggaggccatactaaagcaagttgggttgttcaacatgaatcatgtaaaagtattccagacaaattgggatccctacgatgacttggaaagtgatgttgtgcataacagtattaggagcggtgaaaatgttgctaagtgcctacgagcagttatgcagccgctagtcgcaagccaatttggagaacccattctcgataagttattcaaagactacgctcgccgtgttgccaaacaccttgagaatgagaaaaccaagcatgctattattgtcctatccatcgagaaagcaattcacctgtgaagtgtattgtttctcactatctcgcttattattatcacatgctactatttgtgtagaaaactttgtatgtatgttttttgtgtgtttgtgtcactagtgtattgaatgacatagggtgtttttgttgttttatttatcacttctcctgtattcctatatttcatatgtctaagtttttaatgtgatttcatgcaacccttgtacaagcaattaatacaaataaattgcaccttttatgatct

SEQ ID NO: 8152 - DNA, 1868 bp, Zea mays
ccagcactgaacacttgattgattcagtaggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgcgtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccggtcgcggggaggagggagaaggcaaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcatcatgcttgtgctgaataataatgaagacgcatgcatgtcgtcgccaggaacaaagatcgagaaataatacaagaccagcacgcatgcatgggcatactctatatatatatatgtatagcccgtgcccgtgcccgcctttgtaccaatacaagccaaaccaagtggatgtgtattattattattattgcgctatcacatacatgtacccctgcctgctacctgaagatggatgtgtatcgagttatcaaattaaggcacagcagcagaaactatatgtattgcataagaatactcgtctcgatatggacatgattccctcagctgct

SEQ ID NO: 8153 - DNA, 2044 bp, Zea mays
cgatcaatgatcttcttatacaggttactgctaattctgttcggttagtcagttgcacctcccgggagttagtgaatcaatggaatgcaccagcaggattctcagtcaatgttgcttcagctaatgccagccaggttctgttggcaaccggtggtggccatcttgtttacctggaaattagggatgctaaacttgttgaagtgaagcatgctcagctagaacatgagatttcttgtcttgatttgaacccaattggggagaatccacaatatagttccctagctgctgttgggatgtggacagatataagtgttagaatattttcacttccagatcttgaattgataaggaaggaaaatttgggtggagaaattgttcctcggtctgttctgctgtgcaccttggagggggtttcgtatttgctttgtgctcttggggatggtaatttgttcagttttctactgaatgcaagtacaggtgaactgactgatagaaagaaggttaccctcgggacccaacccatcagccttcgtaccttctcatcaaagggtaccacccacgtgttcgcttcgtccgataggccaactgtcatctatagcagcaataagaaacttctctacagcaatgtcaatttgaaagaggttaatcatatgtgccctttcaatacagccgcttttccagacagtcttgcaattgctaaagagggtgaactttcaattggaactatcgatgatatacagaagcttcatatccgcacaatcccccttaatgaacaagcacgtcgcatttgtcaccaggagcaatcaaggacactagcattttgcagtttcaagtacaaccagagtgtggaggaaagtgagactcatttaatacgtctgctagatcatcagacgtttgagtccctgtgtgtatatcctctagatcaatatgaatgtggctgctccatcattagctgttcgtttgcggatgatagtaatgtttattactgtgtgggaactgcatatgttatacctgaagaaaatgaaccgacgaagggccggattcttgtatttgcagttgaagatggaagcttgcaattgatcgtggagaaagaaaccaaaggagcagtttattcgctgaatgcattcaatgggaaattgttggctgctatcaaccagaagattcaattgtataagtggatgtcacgcgaggatggttcacatgagctgcagtctgagtgtggccaccatgggcacatacttgccttgtatactcaaacacgtggtgacttcattgtggttggcgatctgatgaaatcaatatccttgctggtgtataagcatgaggaaagcgcgattgaagagcgtgctagggattacaatgcaaactggatgactgcagttgagatgcttgatgatgaagtctatgttggggcggagaatagctataacctattcacggtgcgcaagaacagcgatgcggcgacagatgacgaaagggccaggcttgaggtggtgggagagtaccaccttggggagtttgtgaacagattccgccatggttcactggtgatgcgccttccggactcggatatagggcagatccctacggtcatctttggcacaataaacggggtgattggcattattgcctccctcccgcacgaccaatacatcttcctggagaagctccagtcgacccttgtgaagtacataaagggcgtcggaaacctgagccacgagcaatggcggtccttccataacgacaagaagacggcagaggctcggaacttcctcgacggtgacctgatcgagtctttccttgaccttagccggagcaagatggaggaggtgtccaaggcgatgggcgtccccgtggaggagctgtccaagagggtggaagagctaacgaggcttcactagtgtagatggaacatggaagcgttgcttgtaagcaagtagtaacttgttccctgagctgtagcctccgcggctcgcacgatcaaagtgttcggccgtggctgcagtctatccctatgctatcctatcgtgatttgtttgttaac

SEQ ID NO: 8154 - DNA, 629 bp, Zea mays
tcctggcagcctccggcagcgtggccgccatcaagttcgaggtcctctgccgcagcgtcgccgagtgggcggatgtccaggcggtggcgaccgcgtccgcgctggaattcatcgatgtggcctccttccccggcggcgtccctctctacaccgacgaccaggagtggtctagctggaagcgggtcggcgacaaggtcctgcacatcgagctgcgccggtgggccgacgtcctggtcatcgcgccgctatcggccaacaccctcgcaaaggtcgccggcgggctgtgcgacaacctcctcacctgcgtcgtgcgcgcctgggactacagcaagcccgtttacgtcgcgccggccatgaacaccttcatgtgggacaaccccttcaccgcgcgccacctcgccgtcctgcgcgacctcggcatgtccgtcgtcccgccggtcaatggcgcgatggcggagccgtcggagatctgcaagaccctcatgctcttcttcggtccgcaacatctttagcagtcgccaagctcctcagttctttgctcctttatgtatgatgagatgtgtcccttgcttgacctagcatagcaatcttgccacaaaccacggggtagaattagatggcaattgttc

SEQ ID NO: 8155 - DNA, 1198 bp, Zea mays
cgctgccacatctctcctcgtccaaagactccaagctcctgtgcggcctgtgttctgctgccgcctctggtccacatctccccgccgccgccccgtcgtctgccgacacctttagcgctgggaaggatcacaggggatcggcgcgaggcgggggacctgcggtttttgtcgcccggatggcggcggagcgatgacactggcgtcgggagcggcgcggcgttgggatgcggacgatctgcgatgtgtgcgagagcgcaccggcggtgctcttctgtgcggccgacgaggcagcgctttgccggccctgcgacgagaaggtacacatgtgtaacaagcttgctagtcggcatgtgagagttggacttgcagaccctaataaacttgtccggtgtgatatatgtgaaaattcacccgctttcttctactgtgagatagacggcacctcactttgcctgagctgtgatatgactgttcatgttggtggcaagcgaacccatggaagatacctgctcctaaggcaaagggttgaatttccaggagataaaccgggccatatggatgacgtgcctatggaaatccaagatcctgaaaaccagagagaccagaaaaagccacccaaggagcaaacggcaaaccaccataacggcgatgatccggccactgatggcaactgtgatgaccagggtaacattgattcaaaaatgatcgatcttaatatgcgcccggttcgtactcatgggcaagaatcaaattcccagactcagggggtaggtcttagtgtgaacaaccatgactctccaggggtggtgccaacaagcaattccgaaagagacaccagcaagtaaacgttggaagatcggaatatacatttcaactacatatactgttctatacgagttcattttgtggtgtgtgtgtgtgtcactaatttttactcaattctaaattataagtcattctaacttttttgaagaggtaaagtatctcaggtttgactaaaattgtagaggtaatcacagatttatgacatcaactaggtatattttaaaaatataattaattaaaacactaataatacttatttggtatcatgaatgtgattgttttattatataaatttgatcaaacttgagatgctttggctctcttaagaaaattagaatgtactagtaagtatatttttggcagagttgtagct

SEQ ID NO: 8156 - DNA, 1764 bp, Zea mays
tgagctgagctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccaccggtgctgggcccgctacgggaccggctcgactacttctggttccagagccaggacgagttcttccggaagcgcgcggcggcacaccgcagcaccgtgttccgcaccaacatcccgcccaccttccccttcttcgtgggcgtggacccgcgcgtggtcgccatcgtggacgccgccgccttcaccgcgctcttcgacccggacctcgtggacaagcgcgacatcctcatcgggccctataacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctggtggacaacttcggcttcaccatcctggacatctggctggcgctgcagatcctgcccacgcagaagatcggcctcgtccagccgctggaggagctgctcatccactccttcccgctgccctccttcctcatctggccgggctactacgtgctgtaccgcttcatcgagaagcacggcgccgaggccgtggcctacgccgaggcgcagcacggcatcggcaagaaggacgccatcaacaacatcctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaagacggcgacggcgacggcgagttcgggttcgccaccgtccgcgagggcatgccgctggtgcggtcgacggtgtacgagatgctgcggatgcagccgcccgtgccgctgcagttcgggcgcgcgcgcagggacttcgtgctgcgctcccacggcggcgccgcgtaccaggtgaccgcgggcgaggtgctgtgcgggtaccagccgctggcgatgcgggaccccgaggtgttcgagcggcccgaggagttcgtgccggaacgcttcctcggcgacgagggcgccaggctgctgcagcacctcttctggtccaacgggccggagacggcgcagcccgggcccgggaacaagcagtgcgccgccaaggaggtggtggtggacacggcgtgcatgctgctggccgagctgttccggcgctacgacgacttcgaggtggagggcacctccttcaccaagctcgtcaagcgccaggcgtcgccgagcgtggcgcaggcagccgccgccgccggagcgcagcagtgagtgcgctgtataggatcatcggtggcgtgcgacgtcgccggcgccggccaagcaataaagtaaaatgagttcacatgctcgtctgtgttcgacttcgatcggtgtctcttcctcccggccggccgctagccgccgacagccgttgtggtaat

SEQ ID NO: 8157 - DNA, 2491 bp, Zea mays
ctccgtggcttttgcctgtcctgtggcagcgaatcggagagcggaggggaggggaaagcgcagcaacgccggcgagcgagcgggccgttcgaggatcgcaatgtgagcacgagcagggacacacaagatgcttcatcctagctgggtcggtgtctcggcacacgtctcggagtattggtctgtgataatcgccactgttgttttcgcatttgttggcgcggtgacaatttactatacagtcaatcagttgaacaagaacatcagcttgagcctgataagggctatcaaggccagggccaagaggtacaagaaatcgaaggacaaggtgcccgctgcatcccacatctggaggaaagaagttgtctcccgcagcaaaggcctgaaatgctgcgtgtgcttgaagtccgtttcacctcctcagtactctggggggaccatccatcagtgcgatatctgcggggccgctgcgcatccgagctgctcggggaatgcacacaaggattgcaagtgtgtatctatggctggtttgggccatgtgcttcaccagtgggctgtacaatggattgacagcgcggatcactctgaagaagactctttctgttgccactgtgatgaatcttgcaatggagctttccttgcaggctcaccagtttggtactgtatgtggtgtcagcgactggtgcatgttgattgtcacagcagcttggccaaggaaactggtgatatctgtgacttgggaccattgaaacgattgatattatcacctctttgtgttaaggagcttcattggacaggtgctgggattttgagttctatcacaaatggggctaatgaattggcttccagtgtccgagagacaattcggattcgtagtaaaaggtacaaaaggggtagcgcttctgctgattcagatagctctggggctattgagctaccatctgatgctgaaggagattcacaagaagtaaacagcaaagcaaaggtgagggatgatcatgccaattgcaaactcaatgaggtacaccaaagctctgaatcagagaaagataagcaacttgtaccagataacgcagcaacaaccaatatgtcagatgtacaacgtgaaaattctcatgtacagaacaatcagaagtacgaaattatcaatgtgccttctgattctaggccacttctagttttcattaacaagagaagtggggcacagagtggtgattcactgagacagcgtctgcaaattcttcttaatcctgtgcaggttttcgagttgagcaaacagcaaggtccagatgttggtttagctttatttcggaaggtaacccatttcagagttcttgtatgtggtggagatggcactgctggttgggttttggatgccattgagaaacagaagtttgaaaccccgcctcctgtagccatccttccagctggtactggtaatgatcttgcgagggttttatgttggggtggtggccttggtgttattgagaagcggggaggtctattctcagttttgcaagatgtagagcatgctgcagtcactgttcttgacagatggaagatcacaataaaggacaaccaagggaaacttatgagaccaccaaaatttatgaacaactactttggggttggctgtgatgcaaaggttgccttagatatacacaacctgagggaagagaaccctgaacggttttatagccagtttatgaacaaggtgctgtatgcaagagagggagcaaagaacataatggataacacatttgattgttttccttgggatgtcaagcttgagatagatggatccaaaattgatattcctcaggactccgaaggtatccttgttgccaatatcaggagttacatgggaggggttgacctttggaagaacgaggatgatgtctctgacacttacctccctcagtccatgcatgacaagaagctggaagttgttagcttcacaggaatgctgcatctcgggaaactgcaggttgggctttctcgtgcaaaaagattagcccaaggccatcatataaaggttgaagtcagtactacaatgccgatccaagttgatggagagccatggtcccaggagccgggaaccatagaggtttctcatcatagccaggccttcatgcttaagagagtctccgaagaaccgctgggtcatgccgcttcggtaatggccgacatcttggaaaacgctgagagcagtggcattatctcagccttgcagaagaggactttgctccaggagatagcgtctaggcttttgtaggacacagttctaacgccagtagttgtgtgtagctcaccctatagctctctcacgtcttcagcagccagaggcttgcttctgggctactagagaattgcgcctggtcgttgtacatacaccatcatggtattttaccctgattcggattgtgttgtgtatgattctgtaaaattttgtacaccctattgggtgagcacacactgacactgttgcggtcgg

SEQ ID NO: 8158 - DNA, 1848 bp, Zea mays
atctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaagacggatcctgatttgcgtt

SEQ ID NO: 8159 - DNA, 2545 bp, Zea mays
cttcctgacgtcctctcctgtcgatccaaggacaccgggggtttcttggaaacaagttcttggattggtccgccaccagcccaccaccaggcaccatgtcggtctcgccctcgtccctgtgcggcggggacccggcgatgaggatcgtggtgtggttccggagggacctcagggtggaggacaacccggcgctcgcggcggcggcgcgtgccggtggggaggtggtgccggcgtacgtctggtcgccagaggaggagggcccttactaccccggccgcgtatcccggtggtggatcagccagagcctgaaccacctggacgcctcgctccgccgccttggggcgggaaaacttgtcacgcggaggtcggccgacgccgccgtcgcgctgctccagctggtccgcgacaccggcgccacgcacgtctacttcaatcatctatacgacccgatctcactggtcagggaccgccggttgaaggagatgctggcggctgagggcatcgttgtgcaatctttcaattcggatctgctgtacgagccatgggaagttgtcgatgatgaagggcagccattcaccatgttcgacccgttctggaacaggtgcctcagcatgccgtatgacccccctgcaccgcttctgcccccgaagaggatcaattcaggtgacttatcgatgtgcccatcggaggatctgatctttgaggacgagtcagagaggggaagcaacgctcttctggcccgagcgtggacgccagggtggcagaacgcagacaaggcgctgacggccttcctcaacggcccactggccgactactcagtgaaccgcaagaaggccgatagcgcgagcacgtccctgctctcgcctcacctgcacttcggcgagcttagcgtgcgcaaggtcttccacctagttcgcatgaagcagctcgtgtggagcaacgagggcaaccacgctgccgaggagagctgcaccctgttcctccgttccatcggcctgcgggagtactcccggtacctgagcttcaatcacccgagcagccatgagaggcccctcctggcgcacctcaggttcttcccctgggtggtggacgagagctacttcaagatttggaggcagggaaggacggggtacccgctcgtcgatgctggcatgagggagctgtgggcgacggggtggctgcatgaccggatacgcgtggtggtggcaagcttcttcgtcaaggtcctccagcttccatggcgatggggtatgaagtacttttgggacacgttactggatgctgatcttgagagcgatgcgctgggctggcagtacatcactggctctcttcctgatggccgggagcttgaccgcatcgacaacccccagtttgaaggctacaagttcgacccgcatggggagtacgtccggcggtggattcctgagctcgcaaggctgccgacggagtggatacaccatccatgggacgcgcctgtctccgtgctgcaagctgcaggaatcgagctgggctccaactaccctctccccatagtggagctggacgcggccaagggcaggctgcaagcggccctgtcagagatgtggcagctggaggcggcgtcgagggccaccatgaacaacgggacggaggaaggcctcggcgactcctcggaggtcctgttccctcaagagctgcagatggaggtcgaccggcagccagccccagccgaggcagcagccaacgtgcacgtgcccgtgccgatgcctgcccggaggcgcggggaccagatggtgcccaccatgacgacctcttcgctgaacagagctggaacagaggtctccgccgatctagtagtagcgaacagcgaggaggaggacaccagggcgcaggttccgttccacgcgcatctccacccacgagccgaagccccgccagctgcgcgtagaaccaacaacggcgctcgccagcacgacgtcttccagcagcctcggaaccacaggcgagaagctctgcttgctccgtcagcgtcggaggcttcgagcagctggaccggcagagagggcgccgtggtcccggtctggtcgcctcctgcggcgtcgggccattcggacgccttcgctgccgacgaagctgacgtctctagtaggagctatttgggtaggcatccgcagtcccaccggctgatgaactggagccaactatcgcagtcatcgtgagttcagatgcacgcagcagaagattctgtgcggccaaacttaatcgagctgaagattctcgtatgtagattgtccactgaactgctcatccatagtctgatgggatggaaaccaggcggcttttcctggttgtggtggctataggctatagctgtgtaaatctcgtcttctagaacgtgtgtggtcgatatagtgcggttggctttacaacaacaacaaaaaaaagtcgctattattgatcagacgacaaaggttttccgtattttcttagccttttttggggggaggtatgtgatgtgtgtaaccgtaactgtacattcccttgtgctgaccatattgttagtttc

SEQ ID NO: 8160 - DNA, 1405 bp, Zea mays
cttgtcactcatcagcacggttagtatagctagccaccatgaaggtagagcgcgatctccacatgagccggggcgacggcgaggacagctacgcctccaactcaaggcttcaggagaagtccatactgaagacgaggccggtgctgcacaaggccgtggcggcggcgcacgccttgtcgctctcctcaggaggacccggcggcggcgccatggtcgtcgcggacctcggctgctcgtcggggcccaacacactgctcgtcgtctcggaggtgctagcagcggtggcgatggtggccggcggcagcgcccaaccgcagcacgtgcagttcttcctgaacgacctccccgggaacgactttaacctcgtcttccggtcgctggacctgttgaagaacaagaagctggccgccaaggacaggcgggaggagtcgctgctaccgccgtactacgtggccgggctgccgggctccttctacacccggctgttcccggaccactgcgtccacctcttccactcctcctactgcctcatgtggcgctccaaggtccccgacgagctcgccggtggcgcggtcctcaacgagggccacatgtacatctgggaaaccacgccgcaggcggtggtggccctgtacaggaggcagttccaggaggacatgtcgctgttcctcaggcttcgccacagggagctcgtgcccggtggccacatggtgctggcgttcctgggcaggaagaagagcaaggacgtgcttcgtggcgaggtcagctacacgtgggggctcctcgcgcaggctctccagtccctcgtcaaacagggccgtgtgaagaaggataagctggactccttcaacctgccgttctacgcaccttcgatggacgaggtgagggacgtgatcacgcggagccaggcgttcgacatcacccacatccagctcttcgagtccaactgggatccacacgacgacgacgacgtggagatgaagatggaagaagacgtcgccgccgtccagagcggcgtcaacgtcgccaggtccatcagggccgtgatcgggcccctcatcgcccgccactttggcgagcacatactcgacgatctcttcgagctgcatgccaaaaatgtcgcagtgcacctgcagaaagtgaagaccaagtaccctgtcatcgtcgtttccctccaggcgaaatgagccgcgcgccaaataaaggaccaagctagctgatgcaaaatctggcgtcaagttagctattagtaccgctactattatatgcatgcagaataattagtcaaacaatcagaaaaataaagtgcctcagagactgttagtggcagatccaatgtttcgttaattatatgtagtgtaatggtaatggtaatggtaatggtagacatcaggtttcatcgtcc

SEQ ID NO: 8161 - DNA, 1938 bp, Zea mays
tccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagaacatggagagagatgtgtagagagattgtcaagagcccagagttttctggaaaaatcacttttcctgtttccttgaagcagcctgggcctcgagatggaactattcagtgttttattaagagggataaatctacccaaatctacagtctgtaccttagttttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggctggtggcagtgtcccttgccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcaaggacatcttcaccatggactactgctacccgctgtcagccttccaggccttcgccatctgcctgagcagcttcgacaccaagttggcctgcgaataaatcctacctacaattctggtacctaccaaataatcaaaaacactgattgtcgtggtgttcgtccaagaaccgagtttagctgagacgccattgggcaccatgtgctggtgccttgttaactcagaaacgcgtgggggctgaatctgtttcagcagcttccttgtgataatctgtagctgctgcttcgctgctgttgtatcctatgctttcatttctttccggttccgctgtagcttcttaccccccggtgacattagttcggtacccgtatctggatatttttttagccttcttcgttggattgttcaccggtgatggcatgtattaacagagatagttacatacagatgtaatgaattcaggtctggat

SEQ ID NO: 8162 - DNA, 957 bp, Zea mays
cctctaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcacgtaaatggactcatcatgtgaccactctattgttctttgtatttggtatttggtcattgtgggaaggcttcaaggaagatggagattcagaagaattggctgaagttgaagcagagctggatgctgtctttaagagtaataaaggcgaatctaaaactaaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggcggaatcatagcgcaagcactctgcactactgctgctgttcttggtggaaagagcctagcttcccagatatccgagaagatggtcgaactgtcaagcggagttctcttcctgctgtttggtatcatgtcattgctctctggaccaggagaattgtaatccctgcttgaacccttttcagctggctgattgacatatctctctccttagacctatcttatttcagtagatgaatgatggcgacaaaagccatccatccatatggcgaaccggatggtgattcgatagtttagccgacacatcggaaacatttcactcgtccttcataaataactacatgttacagaagtctagcgatttc

SEQ ID NO: 8163 - DNA, 1479 bp, Zea mays
ctcttccgggatggaccaataacattttatatctggacgccccttatcgccctcgttatttacatcgctgccaccctcctctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaacagccggtgtcacaagtgtgcataagctgtggagtcaatatgggagagtacttttgtgatatatgcaaattttatgatgatgatacagacaaagggcagtaccattgcatcgattgtggcatatgcagggttggtggcaaggaaaacttcttccactgtgtgaagtgtggatcctgctattctgttatactccgtgataaccatcagtgtgtggagaactcaatgaggcagaattgcccaatctgttatgagtatctatttgactcattacaaggaacaagagttcttaactgtggacacacaatgcacttgacatgttttgaagaaatggtggcgcataacaaatacacttgtccaatatgctctaaaacagctcttgatttgacacatcattgggaaatgttggatcaagagatcgaagccacgatcatgcctcttgtgtatcgctacaagatttgggtgctttgcaacgattgcaacaaggtctcagaggtgaactttcacgtgattggccacaagtgcagccactgcagatcgtacaacacccgaacgacatcgcgccctgcagatttatcgggaagcagctcaccttcaacagactcatccgacaacaacatatagagaagaaaccattgacagagccaatatgattgaagaaccgaaggaggaaatattgtttcggggcgtgcgtgcttgccaaacttgaagactcccagccgtttattggccctcatcttgtctagattcagttcattccatgagtctttgctgttgtggcaacttccagcttgcgcatcgctgggtcaacaacccacatggccggcgtagctgtccctttgaatcttgttcgcagccgtgattttatcactgtgggtgaaacgtaatcacatacttactgtaatctactatggctgaagatgtgtgcccccctgactcatgccttgtgtgcttgtgctgaactgtttatgaattcccgtgctgttccgtaacactatattgccatttgtgtttccttatctgtcaagtaccgccaagtgtgcggtgaaattgtaatttatttgcaatgaatagaatcttatatctatacctaataataaagactcaacatttct

SEQ ID NO: 8164 - DNA, 1521 bp, Zea mays
gcttctcttgtcactcatcagcacggttagtatagctagccaccatgaaggtagagcgcgatctccacatgagccggggcgacggcgaggacagctacgcctccaactcaaggcttcaggagaagtccatactgaagacgaggccggtgctgcacaaggccgtggcggcggcgcacgccttgtcgctctcctcaggaggacccggcggcggcgccatggtcgtcgcggacctcggctgctcgtcggggcccaacacactgctcgtcgtctcggaggtgctagcagcggtggcgatggtggccggcggcagcgcccaaccgcagcacgtgcagttcttcctgaacgacctccccgggaacgactttaacctcgtcttccggtcgctggacctgttgaagaacaagaagctggccgccaaggacaggcgggaggagtcgctgctaccgccgtactacgtggccgggctgccgggctccttctacacccggctgttcccggaccactgcgtccacctcttccactcctcctactgcctcatgtggcgctccaaggtccccgacgagctcgccggtggcgcggtcctcaacgagggccacatgtacatctgggaaaccacgccgcaggcggtggtggccctgtacaggaggcagttccaggaggacatgtcgctgttcctcaggcttcgccacagggagctcgtgcccggtggccacatggtgctggcgttcctgggcaggaagaagagcaaggacgtgcttcgtggcgaggtcagctacacgtgggggctcctcgcgcaggctctccagtccctcgtcaaacaggtcccttctcttaatttctcttgtgcatgcatgcaagtgcaacatcatgtcagcttgcttcttgatgcattgcattgcgtttgcgttgcattgcatgcatatgtatggcatgcagggccgtgtgaagaaggataagctggactccttcaacctgccgttctacgcaccttcgatggacgaggtgagggacgtgatcacgcggagccaggcgttcgacatcacccacatccagctcttcgagtccaactgggatccacacgacgacgacgacgtggagatgaagatggaagaagacgtcgccgccgtccagagcggcgtcaacgtcgccaggtccatcagggccgtgatcgggcccctcatcgcccgccactttggcgagcacatactcgacgatctcttcgagctgcatgccaaaaatgtcgcagtgcacctgcagaaagtgaagaccaagtaccctgtcatcgtcgtttccctccaggcgaaatgagccgcgcgccaaataaaggaccaagctagctgatgcaaaatctggcgtcaagttagctattagtaccgctactattatatgcatgcagaataattagtcaaacaatcagaaaaataaagtgcctcagagactgttagtggcagatccaatgtttcgttaattatatgtagtgtaatggtaatggtaatggtaatggtaatggtaatggtagac

SEQ ID NO: 8165 - DNA, 2605 bp, Zea mays
gcaccaactgcaaacatcagagaagagaagagtaggggggaaattactactctacgactcgtgcgcccactcctccactgttcttgggaatctcgggggagaagaggaagaaagcagtgggtctcagcgcaccactcattattcctggctccatggcttcctgacgtccctgtgcggcggggacccggcgatgaggatcgtggtgtggttccggagggacctcagggtggaggacaacccggcgctcgcggcggcggcgcgtgccggtggggaggtggtgccggcgtacgtctggtcgccagaggaggagggcccttactaccccggccgcgtatcccggtggtggatcagccagagcctgaaccacctggacgcctcgctccgccgccttggggcgggaaagcttgtcacgcggaggtcggccgacgccgccgtcgcgctgctccagctggtccgcgacaccggcgccacgcacgtctacttcaatcatctatacgacccgatctcactggtcagggaccgccggttgaaggagatgctggcggctgagggcatcgttgtgcaatctttcaattcggatctgctgtacgagccatgggaagttgtcgatgatgaagggcagccattcaccatgttcgacccgttctggaacaggtgcctcagcatgccgtatgacccccctgcaccgcttctgcccccgaagaggatcaattcaggtgacttatcgatgtgcccatcggaggatctgatctttgaggacgagtcagagaggggaagcaacgctcttctggcccgagcgtggacgccagggtggcagaacgcagacaaggcgctgacggccttcctcaacggcccactggccgactactcagtgaaccgcaagaaggccgatagcgcgagcacgtccctgctgtcgcctcacctgcacttcggcgagcttagcgtgcgcaaggtcttccacctagttcgcatgaagcagctcgtgtggagcaacgagggcaaccacgctgccgaggagagctgcaccctgttcctccgttccatcggcctgcgggagtactcccggtacctgagcttcaatcacccgagcagccatgagaggcccctcctggcgcacctcaggttcttcccctgggtggtggacgagagctacttcaagatttggaggcagggaaggaccgggtacccgctcgtcgacgctggcatgagggagctgtgggcgacggggtggctgcatgaccggatacgtgtggtggtggcaagcttcttcgtcaaggtcctccagcttccatggcgatggggcatgaagtacttttgggacacgttactggatgctgatcttgagagcgatgcgctgggctggcagtacatcactggctctcttcctgatggccgggagcttgaccgcatcgacaacccccagtttgaaggctacaagttcgacccgcatggggagtacgtccggcgatggattcctgagctcgcaaggctgccgacggagtggatacaccatccatgggacgcgcctgtctccgtgctgcaagctgcaggaatcgagctgggctctaactaccctctccccatagtggagctggacgcggccaagggcaggctgcaagcggccctgtcagagatgtggcagctggaggcggcgtcgagggccaccatgaacaacgggacggaggaaggcctcggcgactcctcggaggtcctgttccctcaagagctgcagatggaggtcgaccggcagccagccccagccgaggcagcagccaacgtgcacgtgcacgtgccgatgcctgcccggaggcgcggggaccagatggtgcccaccatgacgacctcttcgctgaacagagctggaacagaggtctccgccgatctagtagtagcgaacagcgaggaggaggacaccagggcgcaggttccgttccacgcgcatctccatctccacccccgagccgaagccccgccagctgcgcgtagaaccaacaacggcgctcgccagcacgacgtcttccagcagcgtcggaaccacaggcgagatgctctgcttgctccgtcggcgtcggaggcttcgagcagctggaccggcagagagggcgccgtggtcccggtctggtcgcctcctgcggcgtcgggccattcggacgccttcgccgccgacgaagctgacgtctctagtaggagctatctgggtaggcatccgcagtcgcaccgcctgatgaactggagccaactatcgcagtcatcgtgagctcggatgcacggacagcagcagaagattctgtgcggccaaacttaatcgagctgaagattctcgtatgtagattgtccactgaactactcatccatagtctgatgggatggaaaccaggcggcttttcctggttgtggtggctatagctgtgtaaatctcgtcttctagaacgtgtgtggtcgatatagtgcggttggctttacaaccaaaaaaaaaggtcgctattattgatcagacgacaaaggttttccgtatttttttagccttttttgggggaggtatgtgatgtatgtaaccgtaactgtacattcccttgtgctgaccatattgttagttgtagtttcc

SEQ ID NO: 8166 - DNA, 1784 bp, Zea mays
ccgggtgcactgatctgggggccgcgtgtccccggtggtggggcgaggcggcgccggcttccaggaatgggcagcttgtagtggctgtttcttttgcatatgcgctttctattgttgttgtcatttcaaaggaggccatagtctcctggattttgtatgccttgttatctggaattggtgaccatagatgtcatttcgtagcatagtccgtgatgttagggatggcttcggcagcttgtcaaggagaagctttgaggtgaccctcgcaagcatttatggccttactgggcatcacaaagggaagacccagagctcatcacatgtgctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccggagttttgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttccttggcacaagatttttaatttatgatacacaaccgccctataatggggctgtagttcctcctgccggaaggacaagcaggaggttcaactccacaaaagtctctccaaagctgccttcagtcagttacaacatcgcacaggtatcgtatgagttaaatgtccttggcacgagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcatccatggatttcaatagcgctcgcttctctgacatcgctggcagcagcgctcgcttcacgggcgttcctggtagcagcgctcgcttcgcgggcgttcctggcagcagcgctcgcttctcgggcattgctggcgccagactggacaacgacgaggagagtgaaaccaaggagaggccactggtgcttcgtaataagccgcctaggtggcacgaacagctgcagtgttggtgcctcaacttccgtggccgtgtgacaattgcctcggtgaagaacttccagctgatcgccgcggctaccccgccaccggcaggtgcgccaaccccctctcagcctgccccgtcagatcccgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacatcaggttgcttgcattaggccatcagtgtacctctttccatctggctctcgtgttgccttggttgtatttgtgcttaatgtagccatgaatttggtggcccatatatggacgcatgtgttgttgt

SEQ ID NO: 8167 - DNA, 1776 bp, Zea mays
gcagggaggtggagttgtcaacgtgccgaggactggagcgcccgcgtccggcgtctctataaacgagaccgcccggccatttggtctgctcctctctgttctcccctgcctgcctgcttccagctgcatctctctccgccgagaccgagaggaggaggaggcaagggaggcatccctgacgtacggacggcggccatggggacgcaggcgccggagaactaccccgccgagaaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtccccgggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtcgactaccacctgcgcgcgaccaccacgccggggaaggtgttcggcttcttcggcgcgctgggggacgtggcgttcgcctacgccggccacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaaacacggtcgaggacaacatcctcatcacgctcagcaagcccaagtggctcatcgcgctcgccaacatgatggtcgtcgtccatgtcatcggcagctaccagatctatgccatgccggtgtttgacatgatagagaccgtgctggtgaagaagctgcgcttccctcccggcctcacgctgcgtctgatcgctcggaccctctatgttgcgttcacgatgttcatagccatcaccttccccttcttcggtgggctgctcggtttcttcggcgggttcgccttcgcgccgaccacctatttccttccctgcgtcatgtggctcgcaatctacaagcccaagaggttcagcctctcctggttgaccaactggatgtgcatcattcttggggtgctcctgatgattctgtcgcccatcggagggctccggcaaataataatggacgcgaaaacctaccagttctactcgtgagctaccaccagccatgacttgtaagcacgattggagaaatctgtcaaagcctcaaccacgagtttttgtttttgttttttgtcatgccaaacacatacatatacgtactgtttttttaatattcaaaggtgttcttcgtggcttgcgtgtgtacagtattatgtgtatgagggagacataagtttaatgatgctggctgtcaaagataatggcggttcaatt

SEQ ID NO: 8168 - DNA, 2172 bp, Zea mays
ggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgaagacttcggcgcctacgcggcgccctgggtcgccgagctcgccgcgccgctcgactgcctcaaggcgctccacctgcgccgcatgaccgtcaccgacgaggacatcgccgtgctcgtccgcgcgcgcggccacatgctacaggtgctcaagctcgacaagtgctccggcttctcaacggacgccctccgcctcgtcgcccgctcctgcagatctctgagaactttgttcctggaagaatgtataattgccgatgaagggagcgaatggctccatgaactcgccgtcaacaattctgttctggtgacactgaacttctacatgacagaactcaaagtggagcctgccgatctggagcttcttgcaaggaactgtaaatcattgatttctctgaagatgagtgactgcgatctttcggatttgattggttttctccaaacctccaaggcactgcaagaattcgctggaggcgcttttttcgaagtcggagagtacaccaagtacgaaaaggtcaagctcccacctaggctatgcttcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctactggttctcgaggtgaggaatgtgattggggatagaggactggaagttgttgccgatacatgcaagaagctacgaaggctgagaatcgagaggggggacgatgaccccggccaagaagagcagggaggagtctctcagataggcctgacagccgtagctgtcggctgccgggaactggagtacatagcggcatacgtatccgacatcacaaacggggcgctggagtccatcggcaccttctgcaagaacatgtacgacttccggctcgtcctactcgacaagcagaacaaaataacggatctgccgctggacaacggtgtccgagctctactgaggagctgtaccaagcttcggcggttcgccttgtacctgagaccgggagggctctcggatgcaggcctcggctacgtcggacagtacagcgggaacatccagtacatgctgctcggcaacgtcggcgaatcggacaacgggctgatccggttcgcgatggggtgcgccaacctgcggaagctggagctgaggggctgctgcttcagcgagcgggccctggcggtggccgtgctccagatgccctcgctgaggtacgtatgggtgcaggggtacagggcctctcagacgggccgggacctcatgctcatggccaggccgtactggaacatcgagttcgtgcctccccgtcccgagagcgcgtgtcgggtgatggcggatggacagccttgtgtcgacacccatgctcaggttctcgcgtactattccctcgctggaaggaggccggactgtccgcggtggctggttactttgcatcccgcgtgactgtagatacggcaaggtgtccgagtgtggttactgttactaccagctgcttgtgtaccgtaatgaactgtagtgccgacgtactgtagcggaggtgtagtgtagtgcaataataagttgcggtgttgcttgtactggtatctagtcctaggaggatgtatactaagttatgctgtgctttcttctccccggaattgtattctgttgcttccactgtaaatatcagaaatggctttttgctagtttgggttgaaataatggacctcacaggtgcattgcatgcacaac

SEQ ID NO: 8169 - DNA, 2155 bp, Zea mays
gcttttcgccttaatccccatcaaacccccggacatttctggtcgcaccctcctccggccctcccagccgctaagccctctggaaccttcgagagctcgatcggatcggagcccctgccatggccgacgaggcgaaggcgaagggtaatgcggcgttctcagccggccgcttcgaggaggcggcgcggcacttcacggacgccatcgcgctcgccccgggcaaccacgtcctctactccaaccggtcggcggcgctcgcctcactccaccgctactccgacgctctcgccgacgcgcagaagaccgtcgagctcaagcctgactgggccaagggctactcccgcctcggcgcggcgcacctcggcctcggcgacgccgccagcgccgtcgccgcatacgagaagggccttgcgctcgaccccagcaacgaaggtctcaaggcggggctcgaggacgccaagaaggccgccgccgccccgccgcgtcgcgggccgtccggccccgacgccatcggccagatgttccagggccccgaactgtggagcaagatcgcgtccgaccccaccacacgcgcctaccttaacgagcccgactttatgcagatgctgcgcgaagtgcagaggaacccaagcagcatcagcatgtacctctccgatccccgcatgatgcaggtgctcagcctcatgcttaatgtcaagatccagagacccgaggcctccgagccatcgcagtctaccccaccgccgccgccgcagcagcagcagcagcagacatctcctcttcagacgaaagccagagaggtggagccggagcccgagccagagccgatggatttcactgatgaggaaaaggagcgcaaggagaggaaagctgctgctcagaaggagaaggagttaggtaacacagcttacaagaagaaggacttcgaggcggcgatccagcattacaccaaagccttggaacttgacgacgaggatatttcttatttgactaaccgagcagcagtctatattgaaatgggaaagtacgatgaatgcatcaaggactgtgataaggctgtggagaggggaagggaacttcgtgctgatttcaagatgatctcaagggcactgacaagaaaaggaacagctctagtcaagcttgctaagacctctaaggattttgatattgccatcgagacctaccagaaggctctaactgagcatcggaacccagacactcttaaaaagttgaatgaggctgagagagcgaaaaaggagttggagcaacaagagtactatgatccaaaattagcagatgaggagagagagaaaggcaatgagttcttcaaggagcaaaaatacccagaagcaataaaacactacacggaggctctcaagagaaacccaaaggatcctagggtttacagcaatagggctgcctgctacaccaagttaggagccatgcctgaaggtcttaaagatgcagagaagtgtcttgaactagaccccaccttcactaaagggtacacaaggaaaggtgcaattcaattcttcatgaaagaatatgacaaggccatggaaacctatcaggctggcctgaagcatgacccgaaaaaccaggaactgcttgatggtgttaggaggtgcattgaacaaattaacaaggctaacagaggtgaaataagtcaggacgaattgcaagaaagacagaacaaagctatgcaagacccagagatccagaacattcttaccgaccctatcatgagacaggtgctaaatgatttccaggagaacccaagggcggcccaggagcacctgaagaaccctggagttatgcaaaagattcagaagcttgtaagtgctgggatagtccaaatgagatgatcaggcacacgatgcgattgtacctgcttgttcgtcccttgtgcttggctttgttagttaacgtgccctttaacaagcagcgacggcaaaagaatctttttcccaattggattgtaagtgcagttaacattggattattcatgtttgtggcactgagtctgagtataggcgccgtcttgctttattgatgctggactttgcgtgcttgtgggtgggggttggttccctagctaaagtttagttcatgtcccattaaatatttgaatataatatatgtttaattaggtttc

SEQ ID NO: 8170 - DNA, 1840 bp, Zea mays
acgcgagagcgaaacggaacaccattgttggaaataaaataaaagaacaccacatcgacatcctctcacctccctcgcactccattggatttgggggagctcggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttgggatccttcttggctacgtttccaattatgccttctcaggcctttctgagcacatcaattggaggattatgcttggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttgatatttgtagcatcaataaaattcttattagctccatgtttc

SEQ ID NO: 8171 - DNA, 2295 bp, Zea mays
gggagagaagcggttgtcggaatccactccggccaggggtgcggaggtcggaatggggggaggattggatgaggcggtgaaggtggtggatttggaggacggtgaaggggaggaggaggcagaggccgccgcggcggagggatcgagcatggagatggggatgctgccaaggatgccggtgcgtgtgctgctcgccgaaggcgacgactccacgcgccacgtcatctccgcgctgctccgcaagtgcggctaccgagttgctgcagcctcagatggtgtgaaggcgtgggacctattaaaggaaaaatctttcaaggtagaccttgttttaactgaagttgaactgcctttgatgtctgggttcctcctgttatccacgatcatggaacatgatgcgtccaagaacatccccgttataatgatgtcttcgcatgactcagtaagcatggttttcaaatgcatgctaaagggtgcagcagatttccttgttaagccgataagaaagaatgaattaaggaacttgtggcagcacgtttggagaaaacaactggcaaacggtgggcctaatgttcagcacatacaacgagaagagaatcttgcagaaagaatccaacagaagactggtgtgacaaaagctgataatttggacagagatgtgccctgtaaaaatagagaatgcagtgaacaagaaagtgatgctcaaagttcttgcacaaggtcagagctggaggctgaaagtaagcaaacagacaacattttggagtataagcaatcaactcaaaggcacttgtctattcctagccacaagaatgttgagctaaatggacagaccaaaatacaaagagctaagggtaataacttgatcccagcaagcgaagacgatttatcgccaaagaaaagaacgtgtttgaatgagaataattctgagagagcttcaagagatatggagctagtccacattatggaaaatcagcagaagtataacacacagtgggaggtggatactatgagaacaacatctaggggaaatgatgagaagggctccatcccagcacatcagttggagctttctcttagaagaactgactacggaaaattagagaaccacgagaaaaatgatagaagaacactgaaccattcaacttcctctgcgttttccttgtataattgcagggctgtgccaaccttaggaaatgctggtgatggtcaattatgcagcacctcagaaacactagtggatgttgaaaataaaaatggagattcagcagatccctctcaagacatgactgaaacaaatcgtcctcctattagagttgttcctgtccctgtccaaggtctcacatttgatgggcagccattctggaatggtacaccagtggcatccctattctactctcagtcaactcctcccatttggaatagcaaaacatcaatgtggcaagaatcaaccccacaagcaacttcactgccacaaaaatctccacagaatgaaccaaatgaaatgggggctaaaccagttataaatgcaggggaacaatttgccatgggtcctcccagtgccagtgggaagcagctgcatgttgaaattcttaatgatgatccacggcatatttctcctatgactggtgaaagtggaatcagtaccgtgctagacagcaccagaaatactctgagcagtagtggctgtgatagcatttccaaccagatcactgcccctactgaatcatccaatgtatataaggatgttcctgaaaccccaagcgccgaagggtcacggcatctgagccagcgtgaggctgcactgaacaagttccggctaaagaggaaggataggtgctttgagaagaaggttcgataccagagccggaaattactcgcagagcagcgtccacgggtcaagggccagtttgttcgtcaagatcatagcatccaaggaagctagggtccagttactgagctggaactctattctattatctaaaaaaagtcactgcaagtgactccactgcggtctgcgggtatcctgatgtcagattttgccgaagagttggaagcagtcacactgagttacagtttgctctgtatatttgctgaagtttgtaatatatgtatgtataggctaacgctgttctttcctaggttaggcacaggacctggcacgtttgaaggtttgtcagtaggcgttagaaaatacaggcatactttgtttcaggtcaagatgagatgtgaccttcagtagcgcatgtgtgctttaagtcttgtattacgtaattaagttgtttgatgtttcgggtt

SEQ ID NO: 8172 - DNA, 2894 bp, Zea mays
gggcaaccgatccaccgagaagcttgtggttgtggcggcggcggagagggaagcggggagcgggaggtcggaggtaggcgcggatgccactgttgtgccggcgccggcggggccggtgatgcccgcttgagctgggcctccgtgcgtcggaggtggacgagggagcgaggcggcgccagaccgaggttgcgtcgggctcgatttctactgggctgctgtctgctgagtttacggaagtgtttggccctagaagagttgaagataaggagtggagctaggtttaaactctggtgacttggttgttgtgtgcaacgaatcaactatgctgagtttttctgtagagtaacagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcgttccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttggtc

SEQ ID NO: 8173 - DNA, 863 bp, Zea mays
ccgttgccgctgccgctgccggctgccgctacctatgctcaagtgctcagtgctcaccgctctgcccctgcctcatcacacgcgcgcacggcgcacagataccttttctctcctctcccgtcccactctcctgggcaatcccggcccggcatggcgagcccgtcctcgtccccctcgcggaaggctctgagcaagatcgcctgcagccgcctgcagaaggagctcgcggagtggcaggtcaacccgcccgcgggcttcaagcacagggtcaccgacgacctccagaggtgggtcatcgatgtagcgggggcagcaggcacgctctacactggcgaaacctacaagttgcaggtggatttccccgagcattatccgatggaggcacctcaggttatatttctgcatccagcaccgatgcatccacacatttacagcaatggacacatctgtttagatatactgtatgactcgtggtccccagcgatgactgtcagttctatctgtatcagcatattatctatgctgtccagctcgccagaaaagcaacgcccagctgataatgatcgctatgtcaagaactgtcgcaatgggaggtctccgaaagagaccaggtggtggttccatgatgacaccgtgtgatcggtgttccgattattgttgtcctgtatgcatttagttgccagactatgggagatggacttatttcgaacgacccatttgaccagaaattaacatgctcttgtggtttgtagatgaatgtgcatcagcgtcaggcctgtactttctgattcttacaccgtcgatgatatatagaataatgtttgtatcttgtcaatttacggaacagacatgaaattcaatgc

SEQ ID NO: 8174 - DNA, 2138 bp, Zea mays
aatcacagcggcaggggacagcaaaaatctccatgcccacgctcggcctagatctccggcgagccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacgacccgcgcgaccgggaggcggcctcgctcgtgtgccgccgctggcaccgcatcgacgcgctctcgcgcaagcacgtcaccgtcggcttctgctacgccgtggagcccgcgcggctgctcgccaggttccggcggctcgagtcgctcgcgctcaaggggaggccccgcgccgccatgtacgggctcatccccgaagacttcggcgcctacgcggcgccctgggtcgccgagctcgccgcgccgctcgactgcctcaaggcgctccacctgcgccgcatgaccgtcaccgacgaggacatcgccgtgctcgtccgcgcgcgcggccacatgctacaggtgctcaagctcgacaagtgctccggcttctcaacggacgccctccgcctcgtcgcccgctcctgcagatctctgagaactttgttcctggaagaatgtataattgccgatgaagggagcgaatggctccatgaactcgccgtcaacaattctgttctggtgacactgaacttctacatgacagaactcaaagtggagcctgccgatctggagcttcttgcaaggaactgtaaatcattgatttctctgaagatgagtgactgcgatctttcggatttgattggttttctccaaacctccaaggcactgcaagaattcgctggaggcgcttttttcgaagtcggagagtacaccaagtacgaaaaggtcaagctcccacctaggctatgcttcttggggggtcttaccttcatgggtaaaaacgagatgcccgttatctttccgtattctgcgtcgcttaagaaactggacctgcagtacactttcctcaccactgaagatcactgtcagcttatcgctaaatgccccaacctactggttctcgaggtgaggaatgtgattggggatagaggactggaagttgttgccgatacatgcaagaagctacgaaggctgagaatcgagaggggggacgatgaccccggccaagaagagcagggaggagtctctcagataggcctgacagccgtagctgtcggctgccgggaactggagtacatagcggcatacgtatccgacatcacaaacggggcgctggagtccatcggcaccttctgcaagaacatgtacgacttccggctcgtcctactcgacaagcagaacaaaataacggatctgccgctggacaacggtgtccgagctctactgaggagctgtaccaagcttcggcggttcgccttgtacctgagaccgggagggctctcggatgcaggcctcggctacgtcggacagtacagcgggaacatccagtacatgctgctcggcaacgtcggcgaatcggacaacgggctgatccggttcgcgatggggtgcgccaacctgcggaagctggagctgaggggctgctgcttcagcgagcgggccctggcggtggccgtgctccagatgccctcgctgaggtacgtatgggtgcaggggtacagggcctctcagacgggccgggacctcatgctcatggccaggccgtactggaacatcgagttcgtgcctccccgtcccgagagcgcgtgtcgggtgatggcggatggacagccttgtgtcgacacccatgctcaggttctcgcgtactattccctcgctggaaggaggccggactgtccgcggtggctggttactttgcatcccgcgtgactgtagatacggcaaggtgtccgagtgtggttactgttactaccagctgcttgtgtaccgtaatgaactgtagtgccgacgtactgtagcggaggtgtagtgtagtgcaataataagttgcggtgttgcttgtactggtatctagtcctaggaggatgtatactaagttatgctgtgctttcttctccccggaattgtattctgttgcttccactgtaaatatcagaaatggctttttgct

SEQ ID NO: 8175 - DNA, 1827 bp, Zea mays
ctccagcactgaacacttgattgattcagtaggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgcgtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcgcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccggtcgcggggaggagggagaaggcaaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcatcatgcttgtgctgaataataatgaagacgcatgcatgtcgtcgccaggaacaaagatcgagaaataatacaagaccagcacgcatgcatgggcatactctatatatatatatgtatagcccgtgcccgtgcccgcctttgtaccaatacaagccaaaccaagtggatgtgtattattattattattgcgctatcacatacatgtacccctgcctgctacctgaagatggatgtgtatcgagttatcaaattaaggcacagcagcagaaactatatgtattgcat

SEQ ID NO: 8176 - DNA, 1643 bp, Zea mays
ctcctctctttccccggcacctgtcacgggaggaggatggacaagagcggcggcgaggcggcggcggcggcagcagcagcagacgacgtcgagcggcgggggggcgactacgagcaagacgagcacgagcggagagggacggtgtggacggcgacggcgcacattgtgacggcggtgatcggctccggcgtgctggcgctggcctggagcgtggcgcagctgggctgggtcgcggggcccctcgcgctcgccggcttcgcgtgcgtcacctactacacctccacgctgctcgccggcgcctaccgcgcgccgcaccccgtcaccggccacaggaaccgcacctacatggacgccgtcagatcgtacctcagtcccagggaggtgttcatgtgcggggtcgcgcagtacgtgaacctgtggggcaccatggtcgggtacaccatcacggcgaccataagcatggccgcgatcaggcaggccgactgcctccgccgggacggcgccggcgccggcgcgcgctgcgacgcgccagggaccgtgctgatgctggcgttcagcgtggtccaggtggtgctgtcccagttcccgggcctggagcacatcacctggctgtccgtcgtcgcggcggccatgtcgttcgcctactccttcgccggcctcggcctctccgtagggcactgggtgtctcgtggcggcggcggcctcgggggcagggttgcaggtgccgccgcggcatcctccaccaggaagctctggaacgtgcttctcgccctggggaacattgccttcgcctacactttcgctgaagtattgatcgagatccaggatacactcaagtcaccaccaccggagaacaggacgatgaagaaggcagcaatgtacgggatcggagccaccaccatcttctacatctccgtcggctgcgctgggtacgccgcgttcggttcgaatgctccgggcaacatcttggcggcaggcgggctgggtcccttgtggctcgtcgacattgccaacatgtgcctcatcctccacctgatcggtgcataccaggtatacgctcagcctgtcttcgcttcggttgagaggtgggccgcctcacggtggccagaagccaagttcatgagcagcgcatacaccgtgtccgtcagcatccccctcttgcagagaggatcggtcaccgtcgcgccgcacaagctcgtcctgaggaccgccatagtcggcgcgacgactgcggtggcgctggcgatacccttcttcaacgccgtgctggggctcctcggcgcgttcagcttctggccgctcacggtctacttccccatcagcatgcacatcgcccagggcaagatcgccagggggaccaagtggtggtgccttctgcaggctctgagcatggtttgcttggtgatctcggtggccgtgggtgtaggctctgtcactgacattgtcgatagcctcaaggcctcttctagccctttcaaaattgtaggctaacaggttactgtagtcatgtacaatgctctgagccgatcgtgcgttgaggtttaaaagaactgtggtgcgcgaattcgcgtcaaatatcgaaacttctcgattgtattttcagagagtatttattgaatttgatcagtaagcatcattttgct

SEQ ID NO: 8177 - DNA, 2324 bp, Zea mays
gggcgagagagcggaagcgacccagcagcgaagcgacgactagctctgcggcctctgcctgccccaagcgccgacgatgggtgccggtgctactgccagggacgaggaggctgctaccggccgccaccatgggaggaagccgcatggcgcggcggcggagtacgcgcaggacgggtccgtggacctgcgcggcaaccccgtgctccgctcccagcgcggcggctggaccgcctgctccttcatcgtcggtacgtagcgcgtgcgggcggtgtgccggtgtgtgtgtcgactgtcgactagctacttcctgtttcactcttgctcttgtcgttgcccgcccctcctcggtagagatggatgaaccgcgcgaatggacgatacggccgggcgcctgatgcggtgtgtggtgcatgcatgcagtgtacgagctgttcgagcggatggcctactacgggatctcgtccaacctcatcatctacctgacggacaagctccaccagggcaccgtcgaggcctccaacaacgtcaccaactggtccggcaccgtcttcctcacgccgctgctcggcgcctacgtcgccgacgcctacctcggccgctactggaccttcgtcgtcggctccgccatttacctgctggggatggtgctgctggtgctgtccgtctcggtgccggcgctgaagccgccgccgtgcggcgccggcggcgtgtgcccgcaggcgtcggcgctgcagctcggggcgtacttcggcgggctctacatcgtggccctgggcaacggcggcaccaagcccaacatctccaccatcggggcggaccagttcgacgagttcgacccgcgggagcggacgcacaagctgtccttcttcaactggtggatgttcaccatcttcctgggcatcctcttctcctccaccgtcctcgtgtacctgcaggacaacgtgagctggtccgtgggctacggcatccccacgctgggcctcatggtctccatctccgtcttcctcgccggcaccaggctgtaccgccacagggtgccgcagggcagcccgttcacgagcatgggcagggtcctggccgccgcgctctggaagtggagcgtcccggtcccggccgacgccaaggagctgcacgagctggacgtcgaggagtacgccaggaagcgtaggttcaggatggactccaccgacgccatggccttcctcaacaaggccgccgccgtggccgtgcccagcggcgggccggcgtcgacgccggcgtggagcctctgcacggtgacccaggtggaggagacgaagcagatcctgaggctggtgcccctcctggtggccatgatcgtgccctgcacgctcatcgcgcagaccaacacgctgttcgtgaagcagggcacgacgatggaccggcacatgggcccgcgcttcgagatcccggcggcgagcctgggcgcgttcgtgacgctgaccatgctggtggctgtggtggtgtacgaccgggtgttcgtgagggccgtgcggcggtacaccaaggacccgcgcgggatcacgatcctgaggcggatgggcacgggcatgctgctgcaggtggcgaccatggcggtggcgtcggcgatcgagagccggaggctggcctacgcgcggagccacggcctggacgccacggggggccagctggggctcaccatcttcgcgctgctcccgcagttcgtgctgatgggcctggccgacgcgttcctggtggtgggcaagatcgagttcttctacgaccaggcgccggagagcatgaagagcctgggcaccgccatgtccctcaccgcgtacggcatcggcaacttcctcagcagcttcctgctgtccacggtcacgcgcgtcacgcgggaccgcggccacgcctgggtcaccaacaacctcaacgcctccaacctcgactactactacgccttcctcaccgcgctcggcgccgtcaacttcgtcgccttcctcgcgctcagcgccaggtacaggtacaaggcccagtccaccgacaggatcgacgctgccgtcggcctggggaccgagaaagccaagcttcaggcggagccactgggctgacgtcgacgacgacgacggggtgcgtctgcctctgctgttaaaagcggagaagatcagccatgaatgcgtatcgtccaaggcgacgtgtgtatgtgtagcatcaactcacttgtaaaaaaaaagcacaggatttccacccgaaaccaaaagcagtgtctgcagtatcaactcccttgtaaaaaaagacagtccatgatctttcatttcattcacacgcaaaaaagaagagtatagatc

SEQ ID NO: 8178 - DNA, 1676 bp, Zea mays
aggccgcctccgccccacggagcaggggtccgcgtccgcgccccgctggtggagtctgtctcctgctactgcagattagatacaggccttaaaactgttgttgaggccaggaagtttgttcctggcgcgaaaatgtgcatgcaacctgaagtcaaacaaaacaagcgcaagtcaaggggctcaaaaaaggaaaggtgcaggactcaagcaccacttttacctggccttcctgatgatcttgctattgcctgccttatacgagttcctcgacttgaacagcccaaactcaggatggtttgcaaaagatggaaccgtcttttgtctgggaattacttttactccttgcgtaagaaaattggagtggcagaagaatgggtgtatgtctttaaaagggaccgtgaagggaagatatcctggtatgcctttgatccactccaccagctatggaagtcactcccaccagttccacaagagtattcagaagcattgggctttgggtgtgccgttctgagtggttgctatctgtacttgtttggcgggaaagatcctttgaggggttctatgaggcgtgttgtattctacaatgctcgtacaaacaaatggcaccgggctccggatatgatgaggaaacgtcacttttttggttcttgtgtaataaacaattgtctctatgttgctggaggagagtgtgaaggaatacagagaacactgcagtctgcggaagtttatgatccaaataggaacagatgggcctgtgttactgaaatgaacaatgggatggtgcctttcattggagttgtatatgatggcaagtggttcttaaaggggctagattcccatcgccaagtaactagtgaggtctacttaccatcatccaatacatggtcagcaattgatgatgagatggtcacaggctggcggaacccaagtatttctttcaatggccgtctctattcagctgactgccgggatggctgcaagcttagagtctatgatgagaacacaggaacatggacaaggttcatggacagcaagcaccacttgggcagctcacgtgcctttgaagctgcagctttggtgtcactaaatgggaaactctgtgtcatcaggaacaacatgagcataactcttgttgatgtctccaacccaacaatgagtgttgagacagatagtgcgcgcatgtgggaaactgttgttcggaagggccagcacaggtcgtttgtggcgaacttatggtcgagcattgcaggacggaacttaaagagtcacattatccattgccatgtgctgcaagtttgagggcaggttttgttagtgggaacatgatcaagttttttaagaagcaaaaggttcagatcagtgacagaaccctccatttcgaaggtagtaaggtttcattgcagaatcgcggggaaaaaggtcattggcgtgccactgctgcccccaaagtcccaaatagttatttgctctcttccagaactgaaaattccaattactttctggcaacatttgaagactcttatcattaatggataaggtttttcagattttgagtgcaaaccagaaagtgagtaggaacttccctagtgtaatgacattttccccttgctggcaggctgggaaatgtgtttggtggatatattggtctcttatcatatttatctatctttgcatcg

SEQ ID NO: 8179 - DNA, 1171 bp, Zea mays
cgttcccatgctgatttttttaggcggctgctggcctgcctgtctccactggaagccccgacccacgttagggcgttcgcgccccaagggcccgtgccattggctcagcccgcccggccgacgcgccgcggcgggccgcctcgaagctcccttcccaacgggcggcatgaggatccagtgcgacgcgtgcgaggccgcggcggccacggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcgtcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagatgagagatctctgcatgattctccagtcatgtgatgtgtgtatgtatgcaaaatatgtatgtataccatcatggggtgcactgacgcttacattggacatatgtaattatccagtcatgtgatgtgtatgtacgcaaaatatgtatgtatgccatcatgggatgcactgacacttacgttggacacatatgtaattataaagatcaggctgctggccaggaac

SEQ ID NO: 8180 - DNA, 1240 bp, Zea mays
cttggcttttcctctcgctctcctcctctctcgcatcccaccgcatcacaaccacgacttcctcccgccgccggttggcttcgctgctcgtccacctccgcccggcccgtgggacgagtggggactggagagggtcgcctctgggcttcgcctctcggcggccgagtgtctgcgtcgtccacggagctgagagcctgagactgagactgagagcgaccggcggcggggatggcgagggagaggcgggagataaagaggatagagagcgcggcagcgaggcaggtcacgttctccaagcgccgccgcggcctcttcaagaaggcccaggagctctccgtgctgtgcgatgccgacgtcgcgctcatcgtcttctcctccacggggaagctctcccagttcgccagctccagtatgaatgagataattgacaagtacaacacgcattctaaaaacctggggaaaacagaacagccttcgctggacttgaacttagagcatagcaaatatgcaaatttgaatgagcaacttgcggaagcaagccttcgactcaggcagatgagaggtgaagaacttgagggtttgaatgttgatgaactccagcaattggagaagaacctggaatctggtctgcatagggtgcttcaaacaaaggatcaacaattcttggaacagatcaatgacctcgaacgtaagagtacgcagctggcagaggagaacatgcaactgaggaatcaagtatcccagatacccccagctggcaagcaagcagttgctgatactgaaaatgttattgctgaagaagggcaatcctctgaatcagtgatgactgcgttgcactctgggagttcacaggataatgatgatggttcggatgtatctctaaagttagggctgccttgcgttgcatggaagtaaacaggaaatgaggctccttgtcgattctgggtgtggatgtgggtgtgggtggagctgcggcctcagcggataggcacttgtgtatggttttatggacgaccggcccccgactacgtactgcaataatcttgcattggaagcgagatcggttaacctgatttgtcatccttgtggcttcatgatgcgatgttccgcttgtaccgtttgctagcatgttaactgaatttttagaatcgcatatacttttgttcttatatatcactgtcgtactgctcgtaagatgtatctactttattctatccaatgttgtaacctatcacctgcc

SEQ ID NO: 8181 - DNA, 834 bp, Zea mays
catttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggtt

SEQ ID NO: 8182 - DNA, 2911 bp, Zea mays
ttcctgttctgttcgcaccgcctccgcccccctccctccctagtccctccctccctctccccttccggactctctgctctcctctgctgcggccatccattaatctcctctcctcgccatcgctgcactcactctacgcttccctcctcaagccgagggcttctccgggaaggaatcgccgcgccgggttcctgcaacgccccgccctttgcgcacccggagcaactgagtcgtggctatcgaggatgatgccgcgtttcagataacagagactgtgagagtgcacgacacacttgacatgcagagatgaagatcagtgcgcttctcacctccgcgggcatcaacattggcctctgtgttctattcctgtcactctactccgttctcagaaagcagccggccaatgtcagggtctactttggccgcaggatcgctgaggaacacgatcggctccgaggggcatttatcttggagaggtttgtcccatccactggatggatagtcaaagccctgcagtgtactgaggaagagatcctggctgctgctgggttggatgctgttgttttcaatagaattctagtattcagcatacgcatcttctcccttgccgcagttctgtgtgttttcgggattcttccgctcaattattttggacaggatatacaccatgttcgaattccttcagaatcactagatatatttacaattggcaatgtagaagtgaaatcaagatggctctgggtccattgtgtaaccctgtacataatttctgcagtagcttgcattcttctatacattgagtacaagcacattgccaggttgaagctccttcatcttacaagcgcaacaccaaaaccaaaccattttacagttcttgttcgtggaataccaaaggcagataaagaatcatgcagtgatgttgttgataatttcttcacaaagtatcactcatctagttatctcttccatcaagtagtttacaaagtcgggaaagttcagaagataatgactggcgcaaagaaggcatataagaagttcaaacatttcacagatgaaactgtcgatcaaggttgcaggacagttacctaccgctgttgtctgtgtggagcttcttcaaattctttcaagttgttgaacactgagtgtgagcagaacaaggggaaagcggacaataaatccatcttggacttagacgatgaggaatgcacaactgcttttgtatttttcaaaactcggtatgcagcacttattgcgtcagaaatacttcaaacatctaaccctatgaaatgggttgctaatcttgctccagaaccagaagacgtgtattggtccaatctttggctaccctataagcaactttgggctcgccgtattgctacactcctaggctctatctttttcatgttcatatttctgataccggtgacatttatacaaggactatctcagctagagcagttgcagcagaggcttcctttcctaagaggaatattgaagaagaaatactacatgactcagctagtaactgggtaccttcccagtgtcatactgcaaatcttcctgtacattgttgctccaattatgatgctgttttctacattggagggccctacatctcacagtgaaaggaagagaagtgcttgctgtaaagtgctgtactttacagtttggaacatattctttgctaatgtattatctggtactgtcattagtcaattgaatgtgttatcaagcccaaaggacatacctgtccagcttgctaaagctgtacctggacaggccactttcttcatcacctatgtcctgacctcaggatgggctagtttgtcatctgaagttatgcaactctttggtctgatatggaactttataatcaaatacgttctgagaatgagagaagatacagaattcgttccctcgtttccttaccacacagaagtaccaaaagttctgttgtttggactattgggcttcacattttctgtgctggctcctctgatcttaccttttctgctggtgtacttttgtcttggttatgttgtataccgcaatcagttgctcaatgtgtatcgaacaaggtatgacacaggtggtttgtattggccaattgcatacaacacagtcatattctcacttgtgctcacccagatcatctgccttggtgtatttggccttaaagaatcgccggtagctgcaggcttcactgtacctcttatcatccttactcttttgtttaaccagtactgcagaaaccggcttcttccattattcaagacttttccagcacaggatttaatcgacatggacagggaagatgaacgatcaggaagaatggatgaaattcaccacggacttcattctgcttattgccagttcgctgacactgtagatgtgcccttggataaaattgaaatcgttggtggggatgaggagcaaggctctagctcgggtcagtccagtgttaaagaaacgtgcgaggatcccaagaagcacctggctcaccctacactaaaaggactccctgttaaccgcctccggcatgccgtgaggtcggttactttcctgatcagattgcagaaaagaggtttatcagaacagaaaatcggataattagttagccgccaaccccctttgcttgttggctatataaatgtacagaggcatacatgcatatacgatcgttcccttagaagagagaagggctaatgtagaagtctatgggagaacatcatcatgagtgttgaggtgcaattttgttttgtcgcatggatgagtttgttggttctgcgggttatctggcagattcagctacccaaaccttagccttgcacgttgatgaaattaatgctcatggttttgttgtaagagattaatgtggccaaagtgatctagatgtataatgtcctcctct

SEQ ID NO: 8183 - DNA, 2232 bp, Zea mays
ctccatttccccccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaagacgaggaggggatggaagtggacggggaggcggaagatgagccggggtggccgtgtggggcgccggaggcggggctcggcgagacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacaccccctcgttgatcccatggtcgtttcagagatacggcgatgcctcagcgaggggatcgaattccaaggcgagctgctgaatttccggaaggacggtgctccacttcacaacagattaaggctcgttcctatgcacggcgatgatggctatgtgacgcatgttatcggaatccagctattctctgaggcgaacatcgatctcagcagcgtatcgtatccggtgtacaagcaaaagtccagcagcaggcccagcattcaagatctgaactcatctccccacgagcacgctccgaaaatccagagtgcagaccactgcggcatgcttcagttgtcagacgaagttctcgcacataacatcctatcccgcctgtcaccaagagacgttgcgtccatcggatcggtgtgcaccagaatgcatgagctgaccaagaacgatcacctgaggaagatggtctgccagaacgcgtggggaagggacgtcaccgtgaggctggagatgagcaccaagatggtaggatggggccgtcttgcgagagagctaacaactctcgaggccgcctcatggcggaagttcacggtcggagggcgtgtcgagccttcccggtgcaacttcagtgcctgcgctgttggcaaccggcttgtccttttcggaggggaaggcgtgaacatgcagcctatggacgacacgttcgtgctcaacctggaggccgcaacgccggagtggcggcgcgtcaaggtttctgcctccccgcccggccggtgggggcacactctgtcgtggctgaacgggtcgtggctggtagtgttcggaggctgcgggcagcaaggtctgctcaacgacgtcttcgtcctcgacctcgacgcccagcagccgacgtggagggaggtcgcgagcgagggccctccgctgccgcggtcctggcacagctcatgcaccctggacggctcgaagctcgtggtctcaggtggctgcgccgagtccggcgtcctcctcagcgacaccttcctcctcgacctcaccaaggagaagcctgcgtggagggagatccctacgtcctggtcgcccccgtcccgcctcggccacaccacgtccgtctacggcgcgaccaagctgttcatgttcggtgggctggcgaagagcggctcgctccggctgcgctccagcgacgcctacacggtggacgtcagcgaggacagcccgcagtggaggcagttggccacgacgaccgggttcccgaacatcagtccgccgccgaggctcgaccacgtcgcggtgagcctgccctgtggacggatcatcatattcgggggctccatcgcggggctccactcccccgcgcagctgttcctgatcgatcccgcggaggagaagccgatctggaggatcctgaacgtgcctgggcagccccccaagttcgcatgggggcacagcacctgcgtggtcggcggtaccagggtcctggttctcggaggccacactggcgaggaatggatactgaacgagctgcatgagctctgcctggcaagcaggcccgacgaggacggctgatgacttcttttcgttgcacttgcacacatatggttcgttcgtctctctctgttttacgtcctatatatgcgcgctatgtcttgtttgtgtatcatctactttcagtctgttgctgcgttgtgtgtcggtccgtcggtatgagaaaaaaatagcggaaattgatttttaaaaaattagtctggatgagtttagtctattttattgtcattggagaagttctctttcatcggtctaggataagattctatggtctatatgtatgtatattttcatgtctcagaaaacac

SEQ ID NO: 8184 - DNA, 1167 bp, Zea mays
cccactttcattgagagacgaacacgcgagtagagaatttctcctgcctgctcacgaccgccctctcgccggtcgccggtcgccgctcgcaacgcaagtcggaagaggaatctctccaagctccaatcctccgatcctgccccaacccaagtcccctccaccaggccgcacacctccgccgcccggcgcgaccttgcatccaccagcctgccctctccttcgcgtgaggcggccccggcgaccgcgtcggcagtgcaagaccagaccgaggcttctcccgttggaaggttccagccatggcgagcgccgatctgctgcggaaggaggaggagttctactcctccctctttgattccgcaaaaggcgacggcgtcaagtcgcgctcgcaggtgattgagaggaagattgaatccctcgaggacatggccaccaaggtcagcaaccggagatcaagaagatggttgaacgaccgcttgctgattgagcttgtcccacgccttcatgttgaagaaatcaaaggcctctttgctcctccaccatggggtgaggagctgcccttgtcagcattctgcaggacaagtgttagtgactgggaggccttcaggagcatcgacatggatgctgaggcaagattgatgcaacacatgaaacgatcatccgaaaaacaaaggactcatgtcgacgaagatgaattgattgctctgaatgcttggcgtcgtataggtcgccaaacaagagaagctattaagaaaaaatttctacctgatctacttcaaatatatgaagaacaggttagggccttcattgaaggtactggtgacagcgacgtgcttgtgctgaatgtccaggacccgttccagaggctgcttctgcacggtgtttgtgagttctataacgtaacctcaatgaccacaagcagtgtaagggacgggaagccatggaagagcaccaccatcaagaagaggcatgtcaccggtcttcctccgagaatcacattagttagcttcctgaggatgaggaagaattagtcgtcccagtaacatgtggatgtgagggtcctacactaattcgcctggatgtgtactaaaaagacaaatttgttgctttaggtcgcatctagcatgtaatcaaatgtaaaatatccatgtcaaatgtaaaatacattgc

SEQ ID NO: 8185 - DNA, 992 bp, Zea mays
gacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctaaagatccgtggtttggataaggagtatgagggcaatgttgaggccactggtgaggacttctctgttgagccagctgatgagaggaggccattccgtgctctcttggatgttggccttatcaggactacaacagggaaccgtgtctttggtgccctcaagggagctttggatgggggcctggatattcctcacagcgagaagaggtttgctggattcaagaaggatgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgctgatccttcggttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagtttagtgccatcgaagtggtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctg

SEQ ID NO: 8186 - DNA, 999 bp, Zea mays
ctccaggtccaggctccagctagctgcaagctcatccgtctctgtcgatcagcaagaggccggggtcagaggaatggcggcgacgtcgcggctggcgctggccctcctgctggccgccttggtggcggcgtggcagctgccggcggcggcggtggcggccaactacacggtgggcgacgagaaggggtggaacccggacgtggactacacggcgtgggtgaagaagcacaagccgttctacaagggagactggctcatcttcgagtaccagaacgggcggtcggacgtggtgcaggtggacgaggtcggctacgacaactgcgacaaggccaacgcgctgagcagctacagcaagggccacacctacgccttccagctcaaggacgccaaggactactacttcatctgcagctacggctactgctacaacggcatgaagctccacgtcacagcaaagtcatcatcctcatcctcctcttcctcgtccggatctgactcctcctcctcctcctctgacgacgactcttcctccccctcgccgcccgccaagaagtccaaggccaagaccagcgccgcgccgccaccgtcactcctcgctgccacgcccatggctgccgccgccgccgccgccgctgctctgctcctcaacaggatgctctgatctggtctggtctggtctgctctgcgtatgtagtcacgtcacgtggctccagatcttgcttgggcgctgatgagctacactacactacactagtttttttcttctgcttttagtttttttccccctcaccacttgagattggggaggcatcttctgcttctagcttgcttgctgcttcttgaattgcgtgactgttattggttggttcttgcttccattattttgcctttttctttctttctttcttgcttccagcttgttgttgatgcagttttttttttcaagagacaagattagtataatgtcaagtgtgaatgaagagctctatttatttatct

SEQ ID NO: 8187 - DNA, 1105 bp, Zea mays
acagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggac

SEQ ID NO: 8188 - DNA, 817 bp, Zea mays
caacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcggtgtcttcaatgtgtgaaaacccaattgttcaaccctacaggatccaacaggcaatcgcaacaggcatcttaccattatcacccttgttcctccaacaaccgtcagccctattacagcagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaattaccattcagccagctagttgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctgcacgctatgcctaacgctggcaccctcttacaactgcaacaattgctgccattcaaccaacttgctttgacaaactcaacagtgttctaccaacaacccatcattggtggtgccctcttttagattgcttatgagttatagttcaataatgaagttttttggatgatgtttgtggcgtcccagaaataagaaagtacatttctagatt

SEQ ID NO: 8189 - DNA, 828 bp, Zea mays
caactagcaacatagaaagcacaatagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttcttatttgcaacaacaacaactaccattcagccagctatctgctgcctacccccagcaatttcttccattcaaccaactgacagctttgaactctcctgcttatttacagcagcaacaactactaccattcagccagctagctggtgtgagccctgctaccttcttgacacaaccacaattgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctgatgtttgtggcttcccagaaataagaaagtacatttctagattc

SEQ ID NO: 8190 - DNA, 835 bp, Zea mays
gtgggttggcttctcctccccctccggttcgggttcgggttcgtgaggttctccggggttcggtttcgtgggtgagcggatcgagatggcggcgtcggatgttgagtaccgctgtttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8191 - DNA, 720 bp, Zea mays
gcggggggaggcatcgtcctctccgtgctttctcagaggtgggttggcttctcctcccccaccggttcgtgttcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgcaagctcgctcctctgatgttgtt

SEQ ID NO: 8192 - DNA, 822 bp, Zea mays
caactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttct

SEQ ID NO: 8193 - DNA, 796 bp, Zea mays
gcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccag

SEQ ID NO: 8194 - DNA, 798 bp, Zea mays
caacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattctt

SEQ ID NO: 8195 - DNA, 809 bp, Zea mays
gcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgttctacctgcacgctgcgcctaacgctggcaccctcttacaactgcaacaattgctgccattcaaccaacttgctttgacaaacccaacagcgttctaccaacaacccatcattggtggtgccctcttttagattgcttatgagttatacttcaataatgaagttttttggatgatgtttgtggcttcccagaaataagaaagtacatttctagattctt

SEQ ID NO: 8196 - DNA, 1025 bp, Zea mays
ctgttcgaagctttcagccgagcaccatcgtcacagtcagtagccaagcatatttctttctccgagtgatttgcgctgagcgatcagttcatccagagcgagcggagctgagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcggctacctgggaaagaagaccgacgaggccaagcacaaggccggcgagacgacggaggccaccaagcagaaggccagcgagacgacggaggcgaccaagcagaaggccggcgagacgacggaggccgccaggcagaaggcagccgacgccatggaggcagccaagcagaaggccgccgaggccgggcagtacgccaaggacaccgccgtctccggcaaggacaagtccagcggcgtcatccagcaggccactgagcaggtgaagagcgcggcggcgggcgccaaggacgcggtgatgagcacgctggggatgggcggggacgacaagcagggcgacgccaacaccaacaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttttctacgaatttggcgttgtaagttcgattcgcaggtacgttgctgtgttttttttctgcgccatcaggtgtctgtaaacgagtcgggcgggtttgagtgtcctttgttgtgataataaagttggtaaatcgtaattaatatatagcatgcgactgtcttgctatggcct

SEQ ID NO: 8197 - DNA, 826 bp, Zea mays
agaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaaccacagttgttgccgttctaccagcacgttgcgcctaacgctggcaccctcttacaactgcaacaattgctgccattcaaccaacttgctttgacaaacccagcagtgttctaccaacaacccatcattggtggtgccctcttttagatttcttatgagttatagttcaataataaagttttttatctgatgtttgtggcttcccagaaataagaaagtacatttct

SEQ ID NO: 8198 - DNA, 1239 bp, Zea mays
gcgcgcggcgccagcctccggcgaccggcacccgcctttcttttatacctccgccgcggcgacccacgccaaccttcgacccccctaaccctaccaaagcccgaactctcgagatcacaggacgcggatccaaaccagaggcccctgcctgccctctactcccccaccacaccacagcctaccgccatgtcggcgaccgctacggacgaggccgcggtggaggcgcgcctccaggagctgcgggggaggctcgggaagaagcagcacttcgaggaggccgtaaacgagctcgccgccgccgtccgggaccgctacgccggcgcctcccccgccctccgcaaagcgatgtattcaacggtttgccgcgttgcaacagtgcttcaaaccagatatacagctccaggattctggcatgttggtctgaacctcttcgttggaatagagaagctggtaagtaatcctgctgaaaaggagcacctgaagacctgcatttcgagggcccgtgagcatcttgatgaaaaggaaaatgaggattctgtgccaagcaacagagaagcagacaccagatttctttttgaagggcaccttactgtgggacaggaacctccacctccagcatggcttgttgcccagaatttaacgagggaattgagcatactaactgaatcctctggtgatcaagatgggagcaacaacagaacagtgcctagagccgaggagattacacctgctataatgaacctcctagaaaccatatcaggcgacagggatctagaaactgctttggaagaatcactgcagggaatcattgagtatccacagagggcacccccggcttcaaaggaagttgtcgccaatcttcctgtcattgctgttaccgaggaagtcatgtctagattgggtagtgagacggagtgtgctgtctgccgcgaaaacttggttgtggatgacaagatgcaggagcttccctgcaagcatctcttccatcctctttgtctgaagccatggctggacgagaacaactcctgccctatctgccggcatgagctgaggacggacgaccatgtgtatgagagcaggaaggagcgtgaaagggaagaggaagaagatagaaggggtgcggcaaatgctgttaggggtggagaattcatttatatctgaactcaacagttccagaatgtaatccctttgatgaacttcgttattaccatgttgacatctatatatacctagttactt

SEQ ID NO: 8199 - DNA, 798 bp, Zea mays
gtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgcagccgcagccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagaggtttagtcccatttgcattataacc

SEQ ID NO: 8200 - DNA, 1068 bp, Zea mays
cgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatct

SEQ ID NO: 8201 - DNA, 837 bp, Zea mays
ttgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagattctt

SEQ ID NO: 8202 - DNA, 807 bp, Zea mays
aaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccaacaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 8203 - DNA, 823 bp, Zea mays
caacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaaccacagttgttgccgttctaccagcacgttgcgcctaacgctggcaccctcttacaactgcaacaattgctgccattcaaccaacttgctttgacaaacccagcagtgttctaccaacaacccatcattggtggtgccctcttttagatttcttatgagttatagttcaataataaagttttttatctgatgtttgtggcttcccagaaataagaaagtacatttctagattctt

SEQ ID NO: 8204 - DNA, 821 bp, Zea mays
cctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8205 - DNA, 804 bp, Zea mays
ttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagg

SEQ ID NO: 8206 - DNA, 810 bp, Zea mays
gaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctag

SEQ ID NO: 8207 - DNA, 824 bp, Zea mays
caactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctacccccagcaatttcttccattcaaccaactgacagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccagcagcattctaccaacaacccatcattggtggtgccctcttttagatttcttatgagttatagttcaataataaagttttttgtctgatgtttgtggcttcccagaaataagaaagtacatttctag

SEQ ID NO: 8208 - DNA, 823 bp, Zea mays
caacatagaaagcacaatagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttcttatttgcaacaacaacaactaccattcagccagctatctgctgcctacccccagcaatttcttccattcaaccaactgacagctttgaactctcctgcttatttacagcagcaacaactactaccattcagccagctagctggtgtgagccctgctaccttcttgacacaaccacaattgttgccgttctaccagcacgctgcgcctaacgctggcaccctcttacaactgcaacaattgctgccattcaaccaacttgctttgacaaacccaacagcattctaccaacaacccatcattggtggtgccctcttttagatttcttatgagttatagttcaataataaagttttttgtctgatgtttgtggcttcccagaaataagaaagtacatttctagattctt

SEQ ID NO: 8209 - DNA, 791 bp, Zea mays
ttgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctg

SEQ ID NO: 8210 - DNA, 785 bp, Zea mays
atctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttgaattgc

SEQ ID NO: 8211 - DNA, 973 bp, Zea mays
attggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagtaaaaaaaataaaaataaatctgtagtatgtggatgcaagaaacggctggttagctagctgcaagccttctggggcctgaaaatgaaatccacccatggatacacccaaccaagcttgatgcgctacttttctt

SEQ ID NO: 8212 - DNA, 1107 bp, Zea mays
acagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggac

SEQ ID NO: 8213 - DNA, 1315 bp, Zea mays
cctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccatactgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattacgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatctatgtactatttgtaccacaagagatgtaataaactattgtattgtcaaacggatttgttcaaggaaattatgtgtaatgaacttttgctctagttccatgcaaaagacatttcaatgtacatctgttcatggtg

SEQ ID NO: 8214 - DNA, 979 bp, Zea mays
gctctccagttcaggcgtccagcttcgcccagagtccagacacggccaacagttaaacgcgccaccgccaccacgctcgcacgcacgccccacaggtacagctagctcccacccctcaacagcaacagctaagcttctcctagcagacagcaacatgaccgaggaggaggccaagaaggtggaggtggaagtggaggtcaccaaggcggcgccggcgaaggagaacgccgccgaagagaaggccgtcatccccgcgaccgagccgccggccgcccaggagaagccgccagcgccggccgacgactccaaggccctggccatcgtcgagaaagttgcagataaatctgctcccgagaagcctatcgctgagaagcaagggggctccagtatcagagatctcgctcttgcaagggtggaaacggagaagaggaactctctgattaaagcatgggaagataatgagaaggcaaaagctgataacaaggctactaagaaagtatctgttattctttcatgggagaacacaaagaaagcaaacatagaagctggaatgaagaagattgaggaacaactggaaaataagaaagctgaatatgctgagaagatgaaaaacaaggttgcaatgatccacagggaagccgaagagaagcgagcgatggtggaggcaaagcgcggcgaggaggtcctgaaggccgaggagatggctgccaagtaccgggccaccggccacgcccctaagaagcccattgggtgcttcggagcctaagaaatgttccaagtcacatcgagtagaaagtgagaaacctcaaccagtgattgcttggtcacctcgctctatcaagtgtgtagtgtgtgttcgaaagtgtgtaagtcctactgctcctgtatatatagatatcactttgaagacgtgtaaatgttggatgcttgatgtgaatcttttttatgtatagttaaggagtcacactgttgttttaac

SEQ ID NO: 8215 - DNA, 820 bp, Zea mays
gctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtcc

SEQ ID NO: 8216 - DNA, 789 bp, Zea mays
agcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaatt

SEQ ID NO: 8217 - DNA, 776 bp, Zea mays
ctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataat

SEQ ID NO: 8218 - DNA, 1131 bp, Zea mays
ggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatatt

SEQ ID NO: 8219 - DNA, 813 bp, Zea mays
atacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccatt

SEQ ID NO: 8220 - DNA, 856 bp, Zea mays
tcgcactcgcccaacctcgaatgccaagctagcaagagaggcctcgatcgcagaacccagcggcaaagcaagcacgcccgtgtctacaggcagctctttccatatggcgcccaagaggagcagcgaggagcgcgcggcggcggagcaggagcagccgaggctccgcggcgtgcggaagcggccgtggggcaggtacgcggcggagatccgggaccccgtgaggaaggcgcgcgtgtggctcggcaccttcgacacgcccgagcaggccgctcgtgcctacgacgccgccgcgcgcaggctccgcgggccgcgcgccaccaccaactaccccggcgacgtcgtccgagaagcgccgtgcacggccccggctctggctgcgagcgcgagcggcagcaccgagtcgtcgtcgtcgtcgtcgtcaagggacgacggccacccgccaccgccgctgcctacggcgccgtcgtcgctcggcctgggcctcgggctcttcccggcgacggtggccacccagccgtgcctgttcctggacccggcgccggtggagagggaggaaggggagcgggagcggagctgctgctcccggtcgccgccgtcggtgctggcgggcctcgggttcgacttcgacctcaacctgcctccgcccgccgagatggtcatgtagcgttggagatagtaattctagcaaaaagggattgtgtagtaaataggaagggcaatcggtttgtgtagtagtagtgtagtactagctagccagtttgcctgtgcactagccactagccaatttgcgacttcgcaatgcaaatcaagaaatcgacgggcaaatatttttctcctgcaaaaaaattgcagtgcc

SEQ ID NO: 8221 - DNA, 1498 bp, Zea mays
gcttcgctaccagccagacgggcagctcacgtgtgcaggcagcggccaagatgatggcggaggcgtggacgccggtgccgttcccgccgacggcgccctgcttctggctgcacgacacgcactcggttttctggcggggaggagacgcgtggacggcggcggagaacaaactgttcgagaaggcgctggcgcagatcgaccgtaacgcgcccgacaggtgggagaaggtggcggaggtggtgcgcacgaagacggtcgacgacgtgaggaaccactaccacgacctggagaacgacgtcggcttcatcgaggccgggctcgtgccgttcccgcactacagcggctcggttccgtcgttcgggttcacccaccacgaggattgggacggagggttcaggcgcggctactgccttaagcgcgcgcgcggctcggacccggagcggaagaagggcgtcccctggacggaggaggagcacaagcttttcttgatgggactgaagaagtacgggagaggggactggaggaacatctcgcgcaagtacgtgactacccggacgccgacgcaggtggctagccacgcgcagaagtacttcatccgcctcaactccggcggcaaggacaagcgccggtccagcatccacgacatcaccaccgtcaacctccccgacgaagaccgcggcaacgcgccaccgtccgcggtcaccaccactaccaacccctccgtcgccctcccggacatgaagcccttcattgcgccgctccaagacgcgctcggcgtgtcgcacccctacggcaacgtgaagctggagcctaagagctcgctggtggccggcctgggcttcaacgactccgtcctcctgatgcactgcggacagttgtaacgggctgttcttgcggcgagaaccgctcccgtcgcaacgtacgccaccaaccaccacctcatctatccccgggcgggcatcagggccggcggcacaagtcgcacgtcgtcgtgctaggcttggatgcagagttgcttcaggtgtactcctaccgatcagatggctggcacgtcccgccgcgtgtgacgaggatgaagagtggaacagtctcgtcgtccagctgccagctcgcggcagctccgagtggctgtgttgtgttcatcgagaacaagaggccatggcccatgggcgtacgcgtgccgttccagcgtccatttcggttcagtgtacaaaattcgacaagtacagagtccaacaacttccacggtaccgaacaataaagcattcgataaaaagcctcttccagcgtcaccggcggcttggattaggatccaggatcagaagatttctgtaccggcttaattgttaatgtatttttggtgtgtgcaacatctcccaccagatggtgttaacacttgtagtgtgtgatgcttgtagtggggtctcgcaaggtttttgtccgccattgttgctttgccagttactagctagtagaagtttagacatgatgttctatt

SEQ ID NO: 8222 - DNA, 979 bp, Zea mays; identical to SEQ ID NO: 8016

SEQ ID NO: 8223 - DNA, 826 bp, Zea mays
cttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8224 - DNA, 1048 bp, Zea mays
ctgatggtggatccactggccgccggttttctccagctggagagccattcgtgggcgtaggacgagagagaggatcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatccttactgaagacgggcagtcgtctgaatctgtaatgactgcattgcattcaggaagctcgctcgactgtgatgatggttcagatatatccttgaagttgtcgttgccttgaaaggaaggaccatcgcatcgcatgttatctgcatgagtggggctgacatcagtgcttctaagaagataaagactgggatagtcccattcgcggcattatattggtttaaccagatgtgctatccttgtgcatgtctgtacttcaaagtggctaacgcgaaatttgtatatataatagtgtatgcgctgcgttatcttcgttctaaaaatctgtattgtttcgttgctggcgctatattgttggtgtattatatatatgcacttagttgttatc

SEQ ID NO: 8225 - DNA, 1995 bp, Glycine max
gttcaatatcctagtataccttaataaataatttaagatactatgatgagagcacggttcccattactgttgctgggacttgttttcctggcttcagtttctgtctcatttggcattgcttactgggaaaaagagaaccccaaacacaacaagtgtctccagagttgcaatagcgagagagactcgtacaggaaccaagcatgccacgctcgttgcaacctccttaaggtggagaaagaagaatgtgaagaaggtgaaattccacgaccacgaccacgaccacaacacccggagagggaacctcagcaacccggtgagaaggaggaagacgaagatgagcaaccacgtccaatcccattcccacgcccacaacctcgtcaagaagaagagcacgagcagagagaggaacaggaatggcctcgcaaggaggaaaaacgcggagaaaagggaagtgaagaggaagatgaggatgaggatgaggaacaagatgaacgtcaattcccattcccacgcccacctcatcagaaggaagagcgaaagcaagaggaagatgaggatgaggagcagcagcgagagagcgaagaaagtgaagattctgagttacgaagacataagaataagaacccttttctcttcggctctaacaggttcgaaactctcttcaaaaaccaatatggtcgcattcgcgtcctccagaggttcaaccaacgctccccacaacttcagaatctccgagactaccgcattttggagttcaactccaaacccaacaccctccttctccccaaccatgctgacgctgattacctcatcgttatccttaacgggactgccattctttccttggtgaacaacgacgacagagactcctacagacttcaatctggtgatgccctgagagtcccctcaggaaccacatactatgtggtcaaccctgacaacaacgaaaatctcagattaataacactcgccatacccgttaacaagcctggtagatttgagagtttcttcctatctagcactgaagctcaacaatcctacttgcaaggattcagcaggaacattttagaggcctcctacgataccaaattcgaggagataaacaaggttctgtttagtagagaggaagggcagcagcaaggggagcagaggctgcaagagagcgtgattgtggaaatctcgaaggaacagattcgggcactgagcaaacgtgccaaatctagttcaaggaaaaccatttcttctgaagataaaccttttaacttgagaagccgcgaccccatctactccaacaagcttggcaagttctttgagatcaccccagagaaaaacccccagcttcgggacttggatatcttcctcagtattgtggatatgaacgagggagctcttcttctaccacacttcaattcaaaggcgatagtgatactggtaattaatgaaggagatgcaaacattgaacttgttggcctaaaagaacaacaacaggagcagcaacaggaagagcaacctttggaagtgcggaaatatagagccgaattgtctgaacaagatatatttgtaatcccagcaggttatccagttgtggtcaacgctacctcaaatctgaatttctttgctattggtattaatgccgagaacaaccagaggaacttcctcgcaggttcgcaagacaatgtgataagccagatacctagtcaagtgcaggagcttgcattccctgggtctgcacaagctgttgagaagctattaaagaaccaaagagaatcctactttgtggatgctcagcctaagaagaaagaggaggggaataagggaagaaagggtcctttgtcttcaattttgagggctttttactgaataagtatgtactaaaatgtatgctgtaatagctcatagtgagcgaggaaagtatcgggctatgtaactatgactagagcttcaactatgaataaataaatcgacagcatatgatgcttttgttttgtgtccttc

SEQ ID NO: 8226 - DNA, 1590 bp, Glycine max
aaccactactactcactcactgcagatctcaattgcatcgctgtccatggctaccatcgttagcatcaaggcccgccagatcttcgacagtcgtggcaatccaactgtcgaggtggatttgacttgctccgatggtacttttgccagagctgctgttccaagtggtgcatctactgggatttatgaggcccttgaattgagagatggaggatctgactaccttggaaagggtgtatcaaaggctgttgacaatgtgaacaccgtcattggccctgctttgattggcaaggacccaactgagcagactgctattgacaacttaatggttcaacagcttgatggaactgttaacgaatggggttggtgcaagcaaaagctaggagcaaatgccatattggcagtgtctcttgcagtctgcaaagctggtgctagcgtcctgaaaattcctctttacaagcatattgctaatatcgcgggtaacaaaaagttggttttgcctgttcctgctttcaatgtcattaatggtggatcacatgctggaaacaaacttgctatgcaggagtttatggttcttcctgtgggagcttcctcgttcaaggaagccatgaagatgggtgtagaagtgtatcacaatttgaagtctgtgattaagaagaaatatggtcaagatgcaataaatgttggtgacgaaggtggctttgcccctaacatccaggaaaacaaggaaggcttggaattgctgaaaactgccatcgccaaagctggttacacaggcaaagttgtcattggaatggatgttgcagcttctgaattctacaaggaagacaaaacatacgatttgaacttcaaggaagataacaatgatggctcccagaggatctctggagatgctttgaaagatctgtacaagtcatttgtgtcagagtacccaattgtttcaattgaggatccatttgaccaggatgactgggagcactatgctaagctaactgctgaggttggagccaatgtacaaattgttggtgatgatctcttggttaccaaccccaagagggttcagaaggcaattgatactaaagcatgcaatgctcttctcctcaaggtcaaccaaattggttctgtgactgagagtattgaagctgtcaggatgtccaaaaaagctggatggggtgtcatggccagtcacagaagtggagagactgaggataccttcattgctgacctttctgttggtttggctacgggtcaaattaagactggagctccatgcaggtctgagcgtcttgctaaatataaccagctcttgagaattgaggaggagcttggtgctgaagcagtgtacgccggagctaacttccgtacccccgttgaaccctactaaagttttcaagtggaaaaaacctggagatccacacgagtttgagcattgagatttgggtgcgcggtttttggtgtgatatataagttgatagttggaacattagtcttggtatgataaagaccttgccaataatttgagttctgattcacagagctaggacagttatgtcttaagactttgaaaggtgtttaatgatatttagctttaat

SEQ ID NO: 8227 - DNA, 1794 bp, Zea mays
ggcagccagcaggggaggaggacacgaatcgtagtcggcctcccgcccgccccggcaattgttgttgctgctgcgcgcagggcggttctggattgcggtctgccccacccacgaacaatccatggctccatctccgcctcggcgtgctgcgctcctcctcaccactgtgcttctgctggcggcggccgggtccacccccggcgccacggctgctggcatcttccaggtgcgccgcaagttcaccgccggggtgggagggggtgctggcgccaacatcagcgcccttcgcgcccacgacggcacccgtcacggccgcctcctcgcagccgccgacctccctcttggcggcctcggcctccccactgacactggcctctattacacggagatcaagctcgggacgccacccaagcactactacgtccaggtcgacaccggcagcgacatcctctgggtcaactgcatcacctgcgagcaatgcccccacaagagcgggctcgggttagacttgacgctttacgaccccaaggcatcctcgaccgggagcatggtgatgtgcgatcaggcattctgtgcagccacctttggcggaaagctgccgaagtgcggcgccaatgtgccctgcgaatatagtgtcacctacggtgatggtagctcgacgataggttcctttgtcaccgatgcgctgcagtttgatcaggtgactagggatgggcagacacagccggctaatgccagcgtcattttcgggtgtggtgctcaacaaggtggggatttgggaagttcaaaccaagcccttgatggaattcttggttttggtgaggcaaatacatcaatgctatcacaactaactaccgctggtaaagtgaagaagatatttgcccattgtttggataccataaaaggaggtggaattttttctattggagatgtggtgcagccaaaagtaaaaacaacgccattggtagccgacaagccacactacaatgtgaaccttaagacaatcgatgttggtggcactactctacaactcccagctcatatttttgaaccaggagaaaaaaagggtaccataatcgacagtggtaccaccttgacataccttccagaattggttttcaaagaagtaatgctcgcggtatttaacaagcatcaggatataaccttccatgatgttcaaggttttttgtgtttccaatatcctggaagtgtagatgatggattcccaaccatcacattccattttgaggatgatcttgcactacatgtgtatccccacgagtactttttcgcaaatgggaatgacgtatactgcgtgggattccaaaatggtgcatcacagtcaaaggatggaaaggacattgtgcttatgggagatcttgtcctttccaacaagttggttatctatgacttggaaaatcgagtcattgggtggactgactacaactgttcgtcgagcattaaaattaaggacgacaaaacgggcgcaacatctactgtcaattcacatgacttgtcctcaggatggaagttccactggcacatgtccccggttctattgttggtaacaacggtgtgcagttatttaatatgctaactccactgtaaaggaaatccatctggttcgtatatcctttccacgaaaaggatcggagagatgtagggctttctttaggttgtgttctcccaccacggaaaacaatggaaacagaaaacactgtaatgctttactgagccattgtttaactaggtaatgctgaggtgaggtaatgttctgtcatttctttgggaaaa

SEQ ID NO: 8228 - DNA, 1959 bp, Zea mays; identical to SEQ ID NO: 8020

SEQ ID NO: 8229 - DNA, 1140 bp, Zea mays
cgtcggtcgaggagtagggttctagcgcctatctggtttctccctgcgccgccgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagccgggaacccggaagggcgagaaccccgagaaggcctccatcgaggtcgtgtggaagcccaagaccggccagatcggaaggcaagaaagggaatatgagatgacactcaagaggacgttgcagagcatctgcttgctcacagttcatcctaacaccaccacctctgtcgtgcttcaggttgtgggtgatgatggttctcttatgccatgtgcaattaatgcttcttgtgctgctcttgcatttgctggaatccctatgaaacatctcgctgtcgcaattagctgtggagtgatggacaatggtgtggttatcttagacactagcagagcagaagagcagcaagctaggtcgtttgctcacctggtgtttccgaactcgcgcaagtcagtcgaatcgaaggacccgacacagcgagatgaggagtccgagcgaggattgataacttgcatcacgcatggagcaatgtctgaagatgactatttcaactgcatagagaggggtgtcatggcgtcctcgaggatctcggatttcatgaggaagacactgcagaaggaggcgtccagggatgcctgacctgagtagcaaatgtattagcacgactgagaagctgcctgcctgtgatagacgatggcgatggcaatggtgtgtagacagcagctgggtctctagtttagacggcatgtagtcgtgttagaacgaaggaggcaagggtgcggagtggaggtcaatcggcgtgtgatgccatgtctcaattgtgcggtggagtggtttggtggacttttgatgaacagataatgaggttgtatttggtggtacccaattgtgtgtgttgaaatcatatgatgcacggcacgctgaaattttactcgaacgccgcccgattaaaacaatatccatact

SEQ ID NO: 8230 - DNA, 1792 bp, Zea mays
gcgaatccagcctcatcttcgtctccgatctgccccccgctcagccgcggattctttcgctgcgtggtgggacggagccgagtagtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctcaagtcagagcatggaaagacccagcttggaaacataactgtggatatggtccttggtggaatgagagggatgactggaatgctttgggaaacatccctacttgatccagaggagggtattcgttttaggggcctctcaattccagaatgccaaaaagtgctgccaacagcagttaagggcggcgaacctttgcctgagggtctcctttggcttcttttgacggggaaggtcccaaccaaagagcaagttgatgcactatcaaaggaattgcttgcgcgctcaactgttccagctcatgtctataagacaatagatgctctcccagtagatgcacatcctatgacacagtttaccacgggagtaatggctcttcaggttgagagtgaatttcaaaaggcttatgacaatggattgccaaagtcaaagttttgggagcctacttatgaagactgcttaaatttgattgctcggcttccaccagtggcttcttatgtttaccggagaattttcaagagtgggaaatcaatagaagccgataattctttggactatgcggcaaatttctcacacatgcttggttttgacgaccaaaaaatgctggagctgatgcggctctatgtaacaattcacactgatcatgaaggcgggaatgtcagtgctcatactggtcatctggttgggagtgctctgtcagatccttatctttctttcgcagcggctctaaatgggctagctgggccactgcatggccttgcaaatcaggaagtgcttttatggatcaaatctgtaatcgaggaaactgggagtggtgttaccacagatcaactcaaagactatgtctggaagacactaaagagtggaaaggttgttcctgggtttggtcatggagttctgcgtaagaccgacccacggtattcatgtcaaagggagtttgccctgaagcatttgcctgaggatccacttttccaattggtgtccaagttgtatgaagttgtacctcctatcctcactgagctgggcaaggtcaagaacccatggccaaatgttgatgctcacagtggagttttgctgaaccactttggactatctgaagcacggtattacactgtcttgttcggtgtttcaagaagcatggggataggatctcagctcatctgggaccgtgcccttggcctgccacttgagaggccgaagagtgttaccatggagtggctggagaactactgcaagaacaaggctgcttgaagcttttcacaaatgctgctttttcccaaccttggctgttaataatttaaacgcgagttatagaaatagtcattttcctttggccgttgaataacgcaagagcaatatgctcaggcggaagaattttgtatcttccgtaacttggtgaacatccagatacttgatctgcggcaacaatgggcagaagagattaggacatgctgattgatctttatacgccaacacttgcttttctttaacattacttgttcgctgcagcttt

SEQ ID NO: 8231 - DNA, 1319 bp, Zea mays
gctccccgtttccctctccaactccaatccatggcctccacggatcgctccacgccggcggaggacgagcaacagcagaagcgcccgtctctcttctcgccgtaccagatgccccgcttccgcctcacccaccggtgagcctccatcgcggtggtgctggcgccgatgaccaggtgcagggcgcccgacgcgatcccaggccccgcgctcgcggagtactacgcgcagcggtccacggagggcggcttgctcatctccgagggcaccatcatctcgccgtccggccctgggttccctcgtgtccctgggatatacaatcaagaacagactgatgcatggagaaaggtggttgatgctgttcatgccaagggagctatctttttctgccaactatggcatgtaggccgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccgtaaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggggcagaccgcgtcgcggtccgagtgtccccggccatcgaccatctcgacgcctacgactccaaccccctgcagctcggcctggccgtggtggagcgtctcaacgctctccagcaggaggccgggcggctggcctacctccacgtgacgcagccacggtacacggcgtacgggcagacagagtctggccagcacgggagtgccgaggaggagagccggctgatgcgtgccgtgcgaggtgcctaccgtggcacgttcatgtgcagcggtgggtacacgcgggagctcggggtcgaggccatcgagtccggggacgctgacctggtgtcctacgggcggctgttcatcgctaatcccgacctggtggagcggtttcggcgcgacgccccgctgaacaaatacgtgcgcaagacgttctacacgccggaccccgtcgtcggttacacggactacacattcctcggccagcctaaggcacgcatgtgatttgattattagtgcgttgccgtaattataagaggcggagtattgtttgtatgttgtgacttgagaaaacaagc

SEQ ID NO: 8232 - DNA, 1219 bp, Zea mays
cgcagccggcaccatctcttcccgcaccccccattcgaacgccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaccttttccatcgctgtttattgtgagtggtcctatatcaatggctggtctcagtggtctatacgt

SEQ ID NO: 8233 - DNA, 761 bp, Zea mays
gcgcacggctcacgttgtccgcctcacgtaaaggtcggtgccttcgtctcctatctctcctcgcgcagttccacttcccatttcctccttcgtccgcatcagggacacactgcctccgcatgcggcaagatcctccctcattccccaaacatgagaggagcagaggaggagagatctggcgccgccactgatgcgggaggagaggaggagaaacgggagaggagcgtcggcctgatggccggcctcatggacaaggccaagggcttcgtggtggagaaggtgacgcaaatccccaagcccgaggctgcgctggatcacgtctccttccagagcatcagccgcgagggcgtcgagctgcatagccacgtcgacatcagcaacccctactcgcaccgcatccccatctgcgagatcacctacacgttcaagagcgccggcaaggtgatagcgtcgggcacgatgcccgaccccgggtggatcgcggcgagcggcagcaccaagctagacctgcccgtgaaggtgccgtacgacttcatcgtgtcgctgatgaaggatctcggaggggactgggacatcgactacatgctggaggtggggctcactgtcgacctccccgccattggcgcctttactatcccgctcaccaccgagggcgagatcaagctccccaccttccgggacctattgttctaagcaattcagatgtttggtgtatgaatcgatttgttttcataccataatcagtgctgatgtggatttgc

SEQ ID NO: 8234 - DNA, 646 bp, Zea mays
tccacctccgcccgcgtcgagcgagggacacaccgcctccggccgcgcggcacgatctccgttccccaacatgagcacgacagaggatgagaggtccggcgccgccgcagaagcgggaggaggggaggaggagagacgggagaggagcgtcggcctgatggccggcctcgtggacagggccaagggcttcgtggtggagaaggtggcgcagattcccaagcccgaggcggcgctggatcgagtctccttccagagcataagccgcgagggcgtcgagctgcacagccacgtcgacgttagcaacccctactcgcaccgcatccccatctgcgagatcacctacaccttcaagagcgccggcaaggtgatagcgtcgggcatgatgcccgaccccgggtggattgcggcgagcggcagcaccaagctggagctaccggtgaaggtgccgtacgacttcatcctgacgctgatgaaggatctgggaggggactgggacatcgactacctgctggaggtagggctcaccatcgacctccccgtcatcggcgccttcactatcccgctcaccaccgagggcgagatcaagctccccaccttccgggacttactgttctaggcaatcggcaaatgaaatgatttattatcc

SEQ ID NO: 8235 - DNA, 1083 bp, Zea mays
ccgcagttcccccgcgcccgagacgcaaccccgcgccaggagtaagtttgttcttttatcgatattatcgatatggcgagggaggagaatgtctacatggccaagctggctgagcaggccgaaaggtatgaagagatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctccttagggacaacttgaccctttggacctctgacctcacggaggatggtgctgatgagggcaaagaagccccgaaaggtgaggctggtgacggacagtaatcttgggagagcgcatattgttcgagcccattgttttagatgctctatgctgtcgaagctgaagctgtgccgtgctattattgtagctgatttcctgttccctcattttttttttttatattagtaggctggtagtgttcgaattagttccccattgctttgtgttgccgctagttggcattaagtccgtgtggactggtattattcactggatttgagaagcatgtcagtggttgctct

SEQ ID NO: 8236 - DNA, 1409 bp, Zea mays
actcgccattcctaagtcctaactacctccaaccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgttacccacagggtagtcctcgcaccactgacgagacagcggtcctacggcaacgttccccagcctcatgccatactgtactatcagcagagggcgactaaaggaggtcttctgatcgctgaggccacgggggtttcagacactgctcaagggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagctgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgagcgatctccactgggtatgctgatttggtcgcgttcgggcgcttgttcttggctaatcctgacctgcctcggaggtttgaagtagacgctccccttaacaagtacaacagagacacgttttacatccctgatccggttgttggatacactgactacccatttctttcgtcagatgtataaatgttctcttttcagcaatctgcttttttagattgagtagtaactggttggtgtaccagtaaaatagtagaggaataaaccattggtctgaatgcctcattctcatatatatggacaaaagcaatatgatcgttgtaattgtgcctcaaatcttatagttgtaaaaaatattgtgaag

SEQ ID NO: 8237 - DNA, 1005 bp, Zea mays
caccgagtggcgaccgcctgacgcgcccgtgtcggcaagccgccgacgacttgacgtggggcgggggaaacaaaacaacgcgggcagcgccacggcaagcgcgtccctgccacggcgcggacacagagagtggaaaccggaaggggggaagagagatggattcctccacctcggcggcggcggcaggggaggcggccgtgccgccggaggacgacgtctgctccgtctgccacgaccgcttccggatcccgtgccaggcgaactgctcccattggttctgtggagagtgcatcatccgcgtttggaattatggacctcctgtacaggcttgcaagtgtcccatttgtcgccgccttataaatctactggtgcctgctgcattatcagggcaggaggatggtccacaagctcaacgtattctaggagagattcagcactataactgtatatttggtggagcaccacgcagcctaactcagaggttgcaagacctacccttcttcatccgaagactgttcagagaactaatggacccccagcggaccctcccactcgtgttcagggcgcggatgctgatgatggtcgcactgagtgcaatttatgtgctgagccctgtcgacattcttcccgaaagcatgctgggcctctttggattcgtcgatgacctgctcatcctgctcatcgtgttcctccacctcgccgcggtgtaccggtcgttgctcctgtaccgccacgggggccagtagaagtcgctgcgcataaaccgtttgtttagctggtttccatgtggagttctctgagatcgcagcagcggatttggaagatcgccgactcgccgagtagatggcaacgtcacggacggcttagcctgtccctgctctgtaccattctactacgcctgtttttctgagactctgacacggtgaactgaactttggttggttgatgcaagtgaatttcccttcgttttactcgtcaggaaaagaaagggaaagagtttgcgtt

SEQ ID NO: 8238 - DNA, 2169 bp, Zea mays
gttcctcgtcgtctcgtgttgtttctcgcgttgccattgccccagctgtccgcccgcgcccgcggcaatggcaggcggcgtggtggtgaacgcggccgggggcaagacgtaccccggccgcatgacgccgttcgtgttcttcacctgcctggtggcgtcatcgggcggcctcatcttcgggtacgacatcggcatctccggcggtgtcacgtccatggcgtcgttcctcaaggagttcttcccttccgtgtacgccaaggcggcggcgaacaaggacacgaaccagtactgcaagttcgacagccagctgctgacgctgttcacgtcgtcgctgtacctggcggcgctggcgacgtcgttcgtggcggcgtccgtgacgcgggtgttcgggcgcaagtggtccatgttctgcggcggggtgaccttcctggccgggtcggcgctaaacggcgccgccaccgacgtgatgatgctcatcatgggccgcatcctgctgggcgtgggcgtcggcttcgccaaccagtcggtgccgctgtacctgtcggagatggcgccggcgaagctgcgcggcatgctcaacatcgggttccagctgatgaccaccatcggcatcctggcggcgaacctgatcaacttctggacggcgggcatcgagggcgggtggggctggcgcatcgggctggggctcgcgggcgtgccggcgctcatcatcaccctgggcgcgctggtgctccccgacacgcccaactcccttatcgcccgcgggttcaacgacgacgccaaggcggtgctggtgaagatccgcggcacggacgacgtgcaggacgagtacgacgacatggtggcggcgagcgaggaggcgaacgccatcgagcacccgtggcgcaacatcctggagcgcaggtaccggccgcagctgacggtggcagcgctgatccccttcttccagcagctgacgggcatcaacgtgatcatgttctacgcgccggtgctgttcctgaccatcggcttcggcgacgacgcgtcgctgatggcggccgtcatcacggggctggtcaacatgttcgccaccgtggtgtccatcgtgtgcgtggaccgcctgggccggcgcgcgctgttcctgcagggcggcacgcagatgttcgtctcccagatcgtggtgggcacgctgatcgcgctccagttcggcaccgccggcgtgggcgagatgtcccgctccaacgcctggctgctggtgctcttcatctgcctctacgtcgccgggttcgcctggtcgtgggggccgctgggctggctcgtcccctcggaggtgttcgcgctggaggtccggtcggcggggcagagcatcgccgtgtgcgtcaacatgctgctcaccttcatcatcggccaggccttcctcagcatgctgtgctcgctcaagttcgggctcttctacttcttcgccgggtggatgttcatcatgaccaccttcatcgccctcttcctgccggagaccaagggggtgcccatcgaggagatgaacctcgtctggagccgccactggttctggggcaagtacgtcaacgtcgacacacaacacggcggcgccagcccgagatccaacggcgtctgatctgagcaagctgcagcaacacctcggcacctgacctggccatgcatgcacacgtatactataatctaacaacgtagctgacctgggcaaattgccagcctgacaggggccagggtgctcgaatgtctcactctcaccgccgactaactttccatcaaaattgattcttgttcatactccatagcatgcacagattgattgaactgctacttgagattcttgtcattgttattagagagagagacagagacagaacgattggcatagcatgcagaattgtttggaagaagctagcaaagcagttccttgtttgtatcctctgtaccagaagatgagtttgatctaggattaatccctgcaaggcaaggtaaagtaaattcatgttgtactcaaaactaacttctcccatatctgtacgtcgtataaaacaaatccctgcaatgtgcaaagattgtcccgcgtagtgattttttcgtctccagcaagatctcaaacaagccccaaatctaagtgtaacatgtttgcattcgaattaaaaaattgaatcccttattgtg

SEQ ID NO: 8239 - DNA, 2035 bp, Zea mays
cgcttcccccttccacccgccgatcgccctccgctcgctccaccgcggcgggcgatcgctcatctccccctaacctcccccgctcgcgattcccgaggcgaggtgccacccaccgcagatttcttccgacggacggttggctcgctcaccccctacttcgctgatcggatcgcgtgctgcccgaggtagaggtgatgataaggcatagttgtttgacttagcctgccttagctatttcttgaagctaagggaaataataattggtgttatggcatttagaaatatggtttgtactccccaagtcattaatcttacatcagactcagagagagggcaagctcaaggaggcaatggtagtgagatatctgagcaaggtgcacaacatgctgtcagagttgtaggaaatgcaatgaacattggtctctctggtgtgcgaagttactatgatatgagcataaatcatcaccatcagtctgttcataacccacccccgaatttaggtgttgattctggttttgtcttcgcatcaaatatgtacaatccctgcatgtcatcaacatcaatgaacagacatgtttctcatgctcagagctttggatcagggaatcaagtgttgcctcaaaaccaagtcccaggaactatggatgagagtagcagaaatgacagtattggtgaaagtgctagagagcatattaaaaggaaaaatgctgcagttgctggaagctatcattttgttaatggatttgcaagctcaagctcatcttctcatgcacctcaaaatcctatgcttgggccttgggacccttcttttgaatcaactgtttcttctaatgttgcaccattcaacccatcagaatatcatggacacaacaacagttggccgtccttagaaggatcttccataacaggaagtaatggattcaactcaatggttgttcatccagactcagtacagcgtgggaactatacatttccacccactcatattagccattcatggatgtcccatgctacaaatggtattgctgatggagttccccagtgggaatatgccaatgcaactgctaatattcaaggcagatttgcccattcaggagccacagaaatcgcaaatgttggttttcatgaatatcagaatggcccttcaactatttgtcggggaccagtaccttatttccaccagcatgcgatgcatggcatgcaagctcttgatcctactcaaatgcaagttccttatcaacaatgccacagtaatggtttcttgcatggtggtattaattaccctggaaaccgtctccaattaggtccacgaaatccagttctcttcaccagttctgaacgtgcttttgggcctccacagcatccgttcctggcaaatccagttaaccaccgcaacataaggattctaccacccgagcatgctacaataatggatttttcgagattgtatgaagtgtcaaatactgtagatgagcatagagatatgcgtctagatatagacagcatgacgtatgaggagcttttagcattagaagagcagattggagatgtcaatactggtctgacaaaaagtcacattgtagataaattgaggactagcctatatgttccaggaatatcgagcatgtctgatcagccatctaaatcttctctagagaatgatgcttgcataatatgccaggaggagtaccaggctagagactgcgttggcacccttgactgcggtcacaggtaccacgcggagtgcgtgaagcagtggctgatggtgaagaacttgtgccccatctgcaagacgacagcattgtctgccaacagaagacaaggacagtgagcgggaatggagaagcctgttggttatttgctttgacaaacgttcagctcaattttgtatataaagaagtggtagacaatggcgctacctgtatttgttgttcactttgttgtgactgggagtactcagcttcctgaaactgtacagccataacatttgttatttttcttcaaatgtagaatgttttaaatcgctcagttcgcc

SEQ ID NO: 8240 - DNA, 812 bp, Zea mays
gaatcacacaacagcagctcaaaaaacccaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgagtggtgccgcggcgggcggcgggcccacgcgcacctacgtccgcgacgcgcgcgccatggcggccaccccggccgacgtcaaggagctcccgggcgcgtacgcgttcgtggtggacatgccggggctgggcacgggcgacatcagggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaaacccaagaccatcgaggtcaaggtcgcctgaggtgggactaggtcgaccgatcgtggctctgaagatgtgggagcagtgccagcgagttgtgaggacctctacctgtgtggaatgtggcgaggaataatcgtagtctgtagtgggggtgcttctggtgtgcgtgtttgcttccttcggtcgcggtgtctgtctaccaattcctatctgatgtatcggcttcggtttcgtatgaaccatgccggatgctttcagt

SEQ ID NO: 8241 - DNA, 976 bp, Zea mays
ggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtct

SEQ ID NO: 8242 - DNA, 825 bp, Zea mays
cagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccatt

SEQ ID NO: 8243 - DNA, 982 bp, Zea mays
gcggaacgacgcacgcggacgcctccttgttccgggtcctactcccgccgcctagaggcctcgccctcccccctccggcgaaaaccgattctctccggcgtttcctggtcccttagtgcaagcaaggacaccgctcctctagcgagctccgttctgaagcggcaagaaagatgattaatcttttcaaaataaagggtcaaaagaaagaggaggcagcaagtgctgctggaaaggcccctgttaagaaacagtctgctggggagctccgtcttcataaagatattagtgagctcaacctgccgaagaccacgtcaatttcttttcccaatggcaaggatgatctgatgaattttgagaccaccatccgacctgatgaaggatattacatgggaggcactttcgttttcacctttcaagtgtcctcatcttatcctcatgatcctccgaaggtcaaatgcaagaccaaggtgtaccatccaaatattgatctggaaggcaatgtatgtctgaacattctgcgcgaagattggaagcctgttctcaacatcaacactgttatttatggcctgaatcttctttttacgcaaccaaacgacgaggatcctctgaaccacgaagctgcagttgtccttcgtgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtacttctggaagcaaaatccaaaccgttcatggtgtgatactgtgatgcatctgtttgcccgcctttgtgatgtgtggtatagtggtggtgcataatgacatggaaatgcttctctaactgaatcattcattccataaatcctaaacgaggaatgggaagtggattgttaagcag

SEQ ID NO: 8244 - DNA, 1137 bp, Zea mays
cgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggacctgcggaagagatcagggaggcgcccaagcacgactcgagcgaggggcagtaaagccggctttacatgcctagaagctagtacctagtgtttgctgctgtctaatgacattatgcaatgtgatctggaccctggtttcttgggtgcgacgcttgtagcagccgtcttatgattatttgtcgggaaaatttgggggctccccatatgagatgctgccgggcaagacctcgccatcccccacctcgtttcaggcgggggacgctggagcctggtccggttgggttgggaagccccttaaactgttgtcgcttgcattttaaccttttcatcgccgttcagtggtcct

SEQ ID NO: 8245 - DNA, 805 bp, Zea mays
gaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccatt

SEQ ID NO: 8246 - DNA, 778 bp, Zea mays
gtttcgtcacccctgacgctcgacgcctcttctcctctcctcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgaacagttgagcttggatgacttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgttaaaaaaa

SEQ ID NO: 8247 - DNA, 1342 bp, Zea mays
gctggatcgctatctcttttctagtgcccagggaaagctagctagctcacagctgagctgagggaagaaagcaaggagagggagccagggaggaaggggaaaaacacgcggagagggtgagcaagaaagaaccgaggcggatcgccttctgttcctcctgccggctccgcgagaggaggcactgctcaggggggaagaaagaggtggaacaacgcccggggcagagcagagatgatgcgggagacgtacatggacgtgctgccgccggtggaccacatagccgcacggagcaactggttcccggcggcggcgcgtctgtggacggcggcggagaacaagcagttcgagcgggcgctcgccgggctcgacctctgccgcccggactgggaggaggtggcgcgggccatccccggccggacggtccgcgaggtcgtcagccacttcaagcacctcgaggtcgacgtccagcagatcgagagcgggcaggtgcccttgccggcctacggcggcggggccagctcgttcaccctgcagtgggacggctacggccccggtccgggggacttcaggcacgggtaccgcttcgctggaggctgcgggaggcggcaccacggccgcacgccggagcaggagcggaagaagggcgtgccgtggacggaggaggagcacaggttgttcctcctaggcctgaagaaatacggcaagggggactggaggaacatatcgcgcaacttcgtccagaccagaacgcctactcaggtggccagccacgcgcagaagtacttcatcaggctcaactccggcggcaaggacaagaggaggtccagcatccacgacatcaccacggtcaacctgacggacgaccagccgccctcgccgtcccagtcctccctgatcaccagccagtcgaacgcaccagctccagctccaggtccggctccggccgcagggatatgccaggtcccattggcggccgacgccaagcgacacggtgccagaactctgcccttcagctcaccgaacaggacctctgcggcgccggcctacaggatggagtttcatgaccaacagggcctgcagtgtggccctctgcatgatcagttgctcgccagccagagcgttctgttctaggcgcggtggcagcccaccctgcggcatggatcgaccaggtcaggtgcctagtgtataatacttgtggtatcgctgtagcttcagcgcctgtattgaagggattagccttttgggagcataacagaaaggaggtcttcatttcatggtggtccataatttgttggagaatgtaacaaaaggaacgccgagaattcgatgccatggtattttc

SEQ ID NO: 8248 - DNA, 803 bp, Zea mays
tccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttgaattgc

SEQ ID NO: 8249 - DNA, 795 bp, Zea mays
tcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8250 - DNA, 1330 bp, Zea mays
tcgcattccacccgcccccttttcgcgtgaacgcgccggcgccgcggatcctgccgtcacgaatggaggcgtggccggacgatttccgctgccccatcacgctggaggtcatgacggacccggtcatcctcccctccggccacaccttcgagcgccgcagcatccagagctggctcgacggggggcacctcacctgccccgtcaccaacctcccgctgccgccctccccgccgctcatccccaaccacgcgctgcgccgcctcatagccgccgtctcgccttccgcggcggcgtctctcgtccctgcggagggaggggcgcacgcgaggcaagaagcggtgtcggcggcggcggcggcggcggtgccagcccggcccgcgtcgcccgtgccggcgctgctgaggctggccaagtccggcgccgcagggcggaaggaggtgctggagtccggcagcgcggcggtgctgctgcggcacgcggaggccggggacgaggcggcggccagggcgctgctgcacctcagcctggacggcgacgacacgcgcgtgggcctcgtggcggacggcgccgtggacgcgctgtccgccgcggtgtcccgcggcggcgcggcggcggcgtccgcggccacggcgctgaccagcctcgccaccgtggacgtgaacaagtgcaccatcggggcgcacccctcggccatcccggcgctggcggggctcctccgccgcggcgggccgcgggagcgccgcgaggccgccacggcgctctacgagctctgcaagctgccggagaaccggcgccgcgcggtgcgcgagggcgcggcgcccgcgctcgccgacttcgccgccgccggctccgcgcgcgccgtcgaggtgctcggcctccttgcccggtgccgggaggggcggcaggagctgtgcagggtccccggcgtcgtgtccgtgctcacgggcgccgccgggagcggcaacgcgcgcgcaatcgagcaggccctgctcgtcctcaactggatttgctccgagagcaacgagttggcggtggaagcaatcaagctgcaggctttcgacctctgcgaggctctggtgaacgacgacaactgcaagatcgccaagaacgcggtcgacttggcccggacgctcgagaaagcgtagaattggattgggctgtctcccccaaaacatgagatgagattcgccatgggttttgattcaacacctgctcgattggtcgggtgttggcctcattgtacagaggtagcaacagcaaaggtgaaccttttatctttcttctcttactccgtttcatttccaagttgtagctgcgccgaaaggaggac

SEQ ID NO: 8251 - DNA, 2164 bp, Zea mays
cgcattagcgcggccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagatggcggaaatggagtgatttctatgtgtggttagctgtctgtcgacttgttttgccacagtttgggtgcttaaacgttaacgtacgtactagttcaatatagtgtctcgggggcgaattggttgtttacatgtcatgtgtttatatatgcgcaatgttcgatctcagtggaataagtcaagtgctcttatg

SEQ ID NO: 8252 - DNA, 2504 bp, Zea mays
tatagatgacctcaactccaagtgacaaagtgaacagctgttgaacttcccgtctatttctgtttctttttgctggatttggagatggaggtgaattcctctggtgaggaaacggtgataaaggtaaggaagccatacacaataaccaagcagcgggagcggtggacagaggctgagcacaaacggttccttgaagccttgaaactttatggcagagcatggcagcgcatagaagagcatgttgggacaaagacggccgtgcagatcagaagtcacgctcaaaagttcttcaccaagttggaaaaggaagctattaacaatggtacttctccggggcaagcccatgacattgacataccgccaccacggcctaaaagaaaggctaacagtccatatcctcgaaaaagtggtctcagctctgagacaccaaccaaagaacttccaagtgacaagtcaacaaaaccaaatatgcccttgagcaatgagaatgtactaatggcagaaatttcaaaggaaggagttgtctggaaaagaaagttgctcggaagttcttaatctcttccgtgatgccccatctccatcattttcttcagttaacaaaagctcttcaaatcatggtgcaccgattgaggcaagtaaaacaaaaatccgagatatgaccattatggaaaatagttctcttaaccccaacatgcaagaggatgtaaaggaaatcaatgatcaggagatggaaaggcttaatggtacccaaatcagctctaaatgtgaacactctcatgagggatatttggacatctcaatgcaacaaatgaagctaaagccagagtctgtggagacaacatatgtggacaaacaaaccgcaagagcttcacactccctagcggagagaactgggacaactagcattccggtcactgcaactgaagaaactcattctgttctaacaagtgatcaagtgggaatcaatggaagcatgaacctatccatccatccaatgtttcctgcagatccaaaatttgatagcagtgccacaccacagccttttcctcataattatgctgcctttgctccaatgatgcagtgcaactgcaaccaagatacccacagatcattggtcaacatgtcatccaccttctccagcatgcttgtttccacgttgttgtcaaaccctgccatccatgcagctgccaggctcgcagcatcatactggccagcagctgaaggtaacactccgattgatccgaatcaagaaaatcttgcagatggtgttcaaggaaggagcatagggtctcctccaagcatggcttctattgtagcagctacagttgctgcagcatctgcatggtgggcaacacaaggtcttctccctttcttcgccccacccatggctttttcatttgtgccagctcccagtgctgccttccccacagttgatgttccacgaccttcagagaaagatagagattgcccagctgaaaatgcacagaaggaatgccaagaagctcgaaaacagggacagtttgaaggtttcagagttgccgcttcttcagagtatgatgggagtggaaaaggcgaggtgtctgtccacacagagttaaagatatctcctgtccagaatgctgatgccacgtctgccgcaggagctgacacgactgatgcattcatgaataagaaaaagcaggaccgctcttcatgcggttctaacacaccttcaagtagtgatgtagatgtggacaatgtccctgagaaagagggcaatggtaatgagaaggcgaagcaagcctcctgcagcaactcttcagctggtgacactaaccaccgcagatttagaagcagtggaagcacgagtgattcatggaaggaagtttccgaagagggtcgtctggctttccatgcgctgttcagtagagaaaagcttccgcaaagcttttctcccccacaagcagaaggctcgaaggaagttggcaaggaggaggaagatgaagtcaccacagtggcagttgacctcaacaagagtaccacaagcattgatcatgacctcgacacaattggtgagccaagggcttcctttcccaatgaactgtcgcccctgaagctgaaattgcgccgaacaggcttcaaaccatacaagagatgttctgtggaagcgaaggagaatagggtgccggctagcgacgaggttggtaccaagaggattcgtcttgatagtgaagcatcaacatgagcgatttctacatggttaccgctcggacttcctctgccgccatgaagtttatgacaaagttgtatttacatctaaactagtataggacttaaagaccttgcaatgcaatgcttcatgaaactgttgtgtgctgtattttagtacttgtgaagcagcccggtagactgcttttaaacctttatctcgtagactctgatttaagcatcaagcaactattgaactttatatttttggcgggaaggaaaataattattttttgatttattttgcagggtcatgc

SEQ ID NO: 8253 - DNA, 1180 bp, Zea mays
cagctcatcatcacattcgcatacatctcttctagcacgcaaagatcgagctatagctagctctgcaacaagagagaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcagcggccaaacaggaggcggcggcggcggcgcccggctgcacggcatcgtcagcagccgccacaaacaccaccagcagcagcagcgccgccgtcgtcgttggctccttcgtcaaagtgagcatggacggcgccccgtacctgaggaaggtggacctgaggatgtacaggggctacagggagctccgggaggccctggaggccttgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcaacaatgaagatctcatctgatctatcgagaggacctgcatgcccggcaacaacacgtcgatcgatcgtcatggccttattaattgtttctttctttcttttcttttctgtttaattatttttgttgttctggttggcgccgccgtggattggagggatccccaagccgaaggatgagcttggctggcgcatcgaagcgcatgcaacggatgtgtgcggctttggttctgtaataagacaaccaggggtcctttttttcgatctgttattagcggcacaaaaggagctagatgcatgctgaggttgtttcagttcactctccatgtgtgtctgtacaaacgaaacaatacagttatattgatcgttgatccctt

SEQ ID NO: 8254 - DNA, 1117 bp, Zea mays
ctccaggttccagcgtgcgcgctctcttcccctctccgtcggcgacgactacgccgggtcttcttcagacccaggtcgttgccgcctacgccaggtgcccaaatcttcttagggcccttcgccggcgacgagcacacaagcttggttgacccccaacaaattgcaaaatgtcagccaatgtcggtgaatcaaccagcggtggcagcagcaatgatgcagctggggggagctttgaatgtaacatatgctttgagctgcctcaagagccaatagtgactctttgtggccacctcttctgctggccatgcctttaccggtggctgcacatccatgcacattcgccagagtgcccagtgtgcaaggctcttgtggaggaagacaagcttgttcccctttatggacgcggcaaggatcgtgttgacccaaggtcaaagaacatgcccgagggtgagattcctcaccgcccaactggtcagaggcctgccccagccccccaggccgatgctaacaacaactttgccaatgccaatccaaatgcgaatccatggttcatgggcacaggagtccctttggctaatgcgcgctgggggaactacgcattctcagctgctttcgggggactattccctatgcttagcttccaagttcatgggtttccagatgctgctgcttatgcgcagcctgctgggttccactatgggtatggccatgggcatggattccatggcggccatatgggacacgcccatggcgtccaccgacaagcaccattggggcaacagcagcaggcagatatctacttgaaggccctgctcttcatgattggaattctagtgattgcaagcctcattgcgttttaaaatttgttggcaacgtctaccaggaggcctgctcgtcacggctgggacgtggaattctgggaatgcaatcctcctgacatgtcagagtccgttgatagcttgacatttgtgatggcatattggcccatgaaccgccagaatttcagtgtgtttgtactatagcttggcgctgaatgttgcataagttattattctgtttgcatgaagtgttcatagaatatgtattaatgtctagataagtacctacgtttcgtaac

SEQ ID NO: 8255 - DNA, 1347 bp, Zea mays; identical to SEQ ID NO: 8017

SEQ ID NO: 8256 - DNA, 1137 bp, Zea mays
gatttttttaggcggctgctggcctgcctgtctccactggaagctccggattacgtaggaaaggggcgggcggcatgaggatccagtgcgacgcgtgcgaggccgcggcggccacggtggtgtgctgcgccgacgaggcggcgctgtgcgcgcgctgcgacgtggagatccacgccgccaacaagctcgccagcaagcaccagcggctcccgctcggcgacgccgcggcgctccccgccagcctcccgcgctgcgacgtgtgccaggagaggccggccttcatcttctgcgtcgaggacagggcgctcctctgccgcgactgcgacgagcccatccacgtccccggcacgctctccggcaaccaccagcgctacctcgccaccggcatccgcgtcggcttcagctccgtctgcggcgccagcgccgagggcctcccgccggcgccgcccaagggcagctccaagcccgcggccgtcatcagcgcgccagctgccgggacgaccaccaaaacaaggacggtcaaggacgcgctgccgcaggaggtgccgtcctcgccgttcctgccaccgtccggttgggccgtcgaggacctcctcgagctgtcggactacgaatccagcgacaagaaagactcgtctcttgggctcaaggagctggagtggttcgaggacatcgacctgttccacgcccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagatgagagatctctgcatgattctccagtcatgtgatgtgtgtatgtatgcaaaatatgtatgtataccatcatggggtgcactgacgcttacattggacatatgtaattatccagtcatgtgatgtgtatgtacgcaaaatatgtatgtatgccatcatgggatgcactgacacttacgttggacacatatgtaattataaagatcaggctgctggccaggaacactcatcgttgaggtgggagggcttaagtgaataaaaagcactaatcgttggattaag

SEQ ID NO: 8257 - DNA, 837 bp, Zea mays
cccacggtccggtgagtgcgtgaggagtctggagtcggacggaatcgaaaaggcgaaaactcagtgtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttgggcgtatccaccgtcagctgaagcaaaggactcaggcaaatggtcgcgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacaccctcatcaagggcaccatcgcaggcggaggtgtcatcccgcacattcacaagtccctgatcaacaagtcctccaaggagtgaagactaggggatgtgcatctttagtttaaactagacttctgtgcgctcctcggcgagtccttgtcatcctgtaggttttagttgagctgtcaggttggagctcctctgtgtaacgcttgcctggtactgcttcatcagttatttggttattgtgtttgtgttgagttgttaacttcaggggtgcaaacctggatgcttatttagttatgtgactactgctattcggtttatgttgtggtttgtttttatttttacaattttttctagctgcaattacacttataatatgatgttggtagccctgtggagtgctggggggctcagatttatc

SEQ ID NO: 8258 - DNA, 837 bp, Zea mays
gggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8259 - DNA, 831 bp, Zea mays
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8260 - DNA, 2346 bp, Zea mays
cgagaatagggagagatcagacaagctgttgtcggaatccactccggcgaggaggagtgctgaggtcgaaatggggggaggagcggatgaggtggtgaaggtcgtggattcggaggacggcgagggggaggaggaagaggcagaggccgcggcggcggaggggtcgagcaaggagacgccgatgctgccaaggatgccggtgcgcgtgctgctcgccgagggcgacgactccacgcgccacgtcatctccgcgctgctccgcaagtgcggctaccgagttgctgcagcctctgatggtgtgaaggcgtgggacatattaaaggaaaaatctttcaacatagaccttgttttaactgaagttgaactgcctttgatgtctgggttcctcttgttatccacgatcatggagcatgatgcatccaagaacatccctgttataatgatgtcttcacacgactctgtaagcatggttttcaaatgcatgctaaagggtgcagcagatttccttgttaagccgctaagaaagaacgaattaaggaacttgtggcagcacgtttggagaaaacaactggcaaacggcgggcccgatgtgcagcacatacaagaagagaatctcgcagaaagaatggaacagaagactggcgtgacaaaagctgataatttgaacagtgatggtccccataaaaatagagaatgcagtgaacaagaaagtgatgctcaaagttcttgcacaaggtcagagttggaggctgaaagtaagcaaactaacaacattttggagtatatgcaatcaactgaaaggcatttgtttattcgtagccacaaggatttagagctaaatggagagaccaaaacacgaactaagggtaataacttgattccaacaagagaagacgatttattgccaaagaaaagaacatgtttgaatgacaatgattctgagagaacttccagagatatggagctagtccacattatggacaatcagcagaagcatgacacacagagggatgtggatactatgagaacaacatccaggggaaatgatgagaagaactccatcccagcacaccagttggaactttctcttagaagaactgactatggaaaattagagaaccacgagaaaaatgatagaagaacactgaaccattcaacttcatctgcattttacttgtataattgcaggactgcgtccagcttaggaaatgctggtgatggtcaattatgcagcacctcagaaacactagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggtacaccggtggcatctccattctacccacagtcagctccccccatttggaatagcaaaacaccaacgtggcaagaatcaaccccacaggcaacttcactgccgcaaaaatcgcaacagaatgaaccagttgaaatggatgctaaaccagttgaaaatgcagaggaacaatttgtcgtaggtcctcccagtgccagtgggaagcagctgcatgttgaaattcctaaagatggtctacggcacatttctcctgtgaccggtgaaagtggaatcagtacggtgctagacagcaccagaaatactctgagcagcagtggctgtgatagcacttccaaccggatcaccgcctctactgaaccatcatccaatgtatacaggggcgttcctgaaaccgcaagagccgaaggtttacgacacctgagccagcgtgaggctgcactgaacaagttccggctaaagaggaaggacaggtgctttgagaagaaggttcggtaccagagccggaaattactcgcagagcagcgtccacgggtcaagggccagtttgtccgtcaagatcatagcatccaaggaagctagggtccagttactgagctggaactcttccccattatctaaaaaaaagtcactgtaagtgactccactgcggggtatcctgatgtcaggttttttcgaagagttggaagcaatcacaccgagttacggtttgctgtgtatgtttgctaaagcttgtaatataagtatgtataggctgactcttctttccttaggttaggcacaggacctggcacgttctagacggtttgtcgttagacgttagaaaatacaggcatacttgtgtcctccagtagcacgtcctccagtagcacgtgtgctttaagccttgtattatgtaattagccaaggtgctgtttggttcacgaaatgtaacgtaaagggtaatggtaatggtttacact

SEQ ID NO: 8261 - DNA, 713 bp, Zea mays; identical to SEQ ID NO: 583

SEQ ID NO: 8262 - DNA, 898 bp, Zea mays
caaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggcatgggtggaatgggcggtatgggtggtatgggaatggatgattttgaggatgatagtgatgaagaagaagtgtcgaaacctcaagctgccggacatgctgctgaggccgagaagactgagtcggcggaagccaagactgagtcggctcagagcagctgaagatgcttccgacatgatctaaactagttgtatcgtcaagttaattctgctgaatcggtggacaaacttctacgttgtggcactggccgatcccagtgacttgccctaaaatttacgttctgtctttacatgggcatcctagtgttatgctcatcacattattgatattgtttctgtgatgcttcctttggtcgacaatcatgtgctggagtttggtttactggattgcttttcttc

SEQ ID NO: 8263 - DNA, 779 bp, Zea mays
tcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttgaattgcatgcattgcatgaggtt

SEQ ID NO: 8264 - DNA, 1383 bp, Zea mays
cttccggtcttctcttctccactaccacccgcccgcccgccttctcctccaccactgccccgtcgtggaataggggcaagttcaggcatctcgcttctgtcctggtcgaggggatcggagaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcggactgcgcgatgagccgtccgctggaggaagaggaggaggaaaaggaggacccgctcacctccctcagcctctcgcttcccggcacggaccagcggttccaccacgaccgcgcccacagccagttccaggagctcccggcgtcgccgccctcgccctccccgcctccgccgccggcgggtccgacctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcagctcgtcgacggcgtcatgcgcgccgccgccgagcgggtcggccggatgcagtagctcctgggcgtgcatgagccatcaaatactctcccaaaccgtcaatcgatcttctaggacgaacgcgcagcagctgttcttatcagtagcaaacttccaagttattattttcctttttttaaaactttattctctcgaaccgctgtgaaaccgaaacagcagtgaaaagagtcagcaactgaaaaaaaaaaatatgtgggaactgaaaggtggagaaaaatgtagtaaaggcttgctgaaagccgtgtaaagcgctgcctgcctcctctctctctctctctctctacaggaatgaatcggatcggaacggaatgaaacgagaagagggggacgacgcacattctggtttc

SEQ ID NO: 8265 - DNA, 1073 bp, Zea mays
ctccactccgcttttgcttggttccatcgggccggagagggagaagctagctagctagcagcagctctgttggtgtgtgtgtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcctcgccacagcaagccccatcacatgttggcaatggattattctttcatcccctggaagctgcagcagagccaaccctgcagatcgggttcgctcccgagcatatgaataacttcatgccggcatggctaccctgaagatggatctttgaggcaaagggaataaataaagatgcgatggcagaatcatattgtactgcaagagtgacaattgtgtgttccactcacatatatgacctagttttgtgtgtctatatgtcgaaacccatatgtctgtgattttattatatgttatgtaagcacaaatgaaacatgccggactagttgcttttgcttgtc

SEQ ID NO: 8266 - DNA, 820 bp, Zea mays
ctagctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccc

SEQ ID NO: 8267 - DNA, 1241 bp, Zea mays
ctcgagaggcacctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactaaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttaatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccttagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 8268 - DNA, 1079 bp, Zea mays
gagcgaccggccagtgctcccccgaccccgagtcccgaggccgacgccattcctgattcctccatcttccgttccgccgcaccgccgccggagatatgtcgaggctcgctgctgccgccctccgctgcgtcgtcactgcatcgagagatacctcctcatctcgcttcgccgtgtctgcgccggtgtctgctcggctcttctccgcggatgcatccggtgaagccgccgccacggccgcagagtcgcaggatgactctttcttcaaggcatcccgcgaaggattagcctatggaaggttttacagtgtcattggtggaggcagtcgtcttgagaagaacatattgaaaactgatattatccatcaccttgacagatgtggattgtcattggatgatgtgaagattgaatacaacaagggatatgctccattggccgctttgttgaggttttcttcgaaggcaatgtttaccaccgcaattaggcaagcaaatcagaatcgtctgcacaggattgatgagataagtcgtgaaacatgggatctcaaaaagtccttcgatgggaaagcggtattactgcaaggagtcccacgaaatgccctcgcagacgacatagagcggtttttgtgtggcacgaactttgaacctccaccgtttgaaacctttctaagagctggtgtcccagagcccataagaatgatgctggttaaattccacacgaagactgatgcgatgaatgccttcatcaccaaaaacaggagtttctgtctgaacagtcaagttagcatgcgtgttctccagtaactgagtagccagtcgaatctcgtgatgtttgccccggctttgtcaaacaaaaagccttttaagtccgatctgaggtctatccagtatccacaaatgttgccgtattgtgtggttgtgcaggttatattggactggcagcctgctttaggttttgattcctactagtttgtggtttcagctgtactgcaccgcttttatttcatgagtactctggaaaatgtaccaccattccgctttacaatgaaataattaacggcacaaacgctaggggttcgaatc

SEQ ID NO: 8269 - DNA, 2055 bp, Zea mays
gcagcccgccgcgcagagcagcgcagcgcagcgcaggcgccctccaactccgggctccgcaaccgctgctccccctccctccctccctccagctcggcctgcctcagcccgcgccgcgcgatgtcagaggaggacgaggaccagccgccgcccaagcggccgtgcgcgtcgccgcccgcggaccaggtgctcgacaacgtgctcgagacggtgctccagttcctggacgccccgcgggaccggagcgccgcctcgctggtctgccgctcctggcaccgcgccgagtccgccacccgcgactccgtcgccgtccgcaacctcctggccgcctcggccacccgcgccgcgcgccgcttccccaacgcgcggagcctcctcctcaagggccgcccgcgcttcgccgacttcaacctcctcccgcacggctgggacgcctccgccttccgcccctgggccgccgccgtcgccgcggggtccttccccgcgctcacctcgctctacctcaagcgcatccccgtcaccgacgctgacctcgacctcctctcccgcccgctcccggcgtcattccgcgacctcacactgcacctctgcgacggcttcacctcgcgcgggctcgcctccatcgcctcccattgcaggggcctgcgagtgctcgacgtggtggagtgcgacatggccgaggagcaggaggtcgtggactgggtggccgcgttcccgccggagcccaccaacctggagtcgctctcgttcgagtgctacgagccgcccgtggccttcgccacgctcgaggcgctcgtggcgcggtccccgcgcctcagccgcctgggggtcaacctgcacgtctcgctcggccagctgcgccgcctcatggcgcacgcgccgcgcttgtcgcacctgggcaccgggtcgttccgcccggcggaaggcggcgaggaggaggcagagttcggggaggttgtctctgcattcgtgtccgctgggcgagcgcgcacgcttgtttctctctccggcttccgtgacctcgcgcaagagtacctgccaatcatcgacgtggtgtgctcccacttgaagagccttgacttaagctacgccgcggtcaccccgaatcagatcctgatgttcatcgggcaatgctacaaccttgagacgctatgggtacttgactcggtgcgtgacgaagggctcgacgccgtggggatttactgcaagaagctccagactcttcgcgtgctcccattggatgcgcatgaggatgccgacgagttggtatcggaggttggccttactgccatcgcacggggctgccctgctctccgttcaatactatatttttgccagacaatgaccaacgctgctgttgtcgacatgtcgctccactgcccggagctcaaggtattctggttatgtataatgggacgacaccagccggaccatgcgactgaggagcccatggatgaaggattcggtgccattgttaagaactgtaggaagcttaccaggctatccacgtcgggtcaacttactgaccgggcgtttgagtacattggcaggcatggcaagtccctgcggacgctctctgtagcgtttgctggaaacagcgacgtggcgctgcaatacatcctccggggctgctcaaagcttgagaagctggagataagggactgccctttcggtgatgccggcctactctctgggatgcaccatttctataacatgcggttcgtctggatgtcaggctgcaacctgaccctgcgggggtgcaaggaggtggctcgggggctaccacgaatggtggtggagttgataaatggccagcctgatgagaacgagaggaaggaaagtgtggacatcttatacatgtatcggtcactcgatggtccaagggaagatgtaccaccatttgtgaagatcctgtgaagctgcttctggtagtatcatgctgctgcccttgatatgctagttgagtgcagatcatttaacggaatatatgtaagatgttgggctgcagatatggtacaattttttttatctcttcaaattcttaggaggatttcc

SEQ ID NO: 8270 - DNA, 2032 bp, Zea mays
ctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaagctattgttatgaaaatttgtcgtctgtaagcatgtgaacttccgacgttgccacatgctggatcagtctgaataagtaagtatgcagctctaggtggtcagctgcgtctaccacaatgagcatgtacgtatggagaaatatctgtgaacccattttgtttatgaataagatttgttttttcgagtt

SEQ ID NO: 8271 - DNA, 719 bp, Zea mays
ggcgttgggcggcccggccgagccggggccctatatatgagggagaggacccctcactagggtttcctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgccatgtt

SEQ ID NO: 8272 - DNA, 1503 bp, Zea mays
cgaggctgctgtctcacggctgcggctgcggcggttcgggctccagactccagggatggccgccggtgcgggaggcggcgaactggaggcgctggagggcgtgcgctccatcgtgctcaagccgtcggagtcgctcgacgagtcgcgtttcacgaggatcgccggcgccgacttcaacgacccggccatcggactccaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtgcattgcgatgcaagtatcgctttcccgcttcttgttgcagcaacatttgcacgtaaggttcataactccaaatgaacagactgaatcggattcggtggagtgaatgggcaacagaattttgttgaactctccaaatgaccttttggagcacgaggtctacttcacctgcacagggatcatgtgcaagttttttcggtgactcgcggcaaccacatgccatcattatttcgatgttcacttgatgctgtactagctggttgatagcatttttgttacaactgataatttattgaaatacagacatacgattgttcatccgagtcgtctgcttacgaattttttgtagaccgaaacatctgcttacgaaattgacaaatggcctgttttatgaacacattttttttcacctg

SEQ ID NO: 8273 - DNA, 1213 bp, Zea mays
gcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctatttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgaaaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataatgggtcaactgacaactctgggtcggtggatttgtagttggtttgggttttttagttgtagaacggtgttgcccccctcctagagagggatgaacacattatgcatgcgatgtgtcagttcggtcggtgctatgctcgttgggatttgattgtcggaaataaaacatgggtgatgaatgtgtaccctccctaatctatgtcttggtgatgaagttgagaaagccctgcgggtgtaggtggatttgtagagttttttcttcagttggttaggttcgctgttgcctacctcatttgcccctcatcatcgccgtaatttatttatttataatataaaagatccagattttccccc

SEQ ID NO: 8274 - DNA, 1595 bp, Zea mays
gcgtgagatcgaggagaagaaggcaagcaggcagagaaagagagagagagagagagatggatgaggagtacgacgtgatcgtgttggggacggggctcaaggagtgcatcatcagcggcctcctctccgtcgatggcctcaaggtccttcacatggacaggaatgactactacggaggagaatcttcgtccctgaatctaaccaagctctggaacaggttcaagggcaacgacagccctcccgagcacctgggcgtcagcaaagagtacaacgtcgacatggtgcccaagttcatgatggcaaacggcgcgctggtccgcgtcctgatccgcaccagcgtgaccaagtatctcaacttcaaggctgttgacgggagctttgtgtacaacaatggcaagatccacaaagtcccggcaaccgacgtggaggccctcaagtcgaacctgatgggcctgttcgagaagcggcgcgcccggaagttcttcatatacgtgcaggactacgaggaggacgaccccaagtcccacgagggcctggacctcaacaaggtcaccaccagggaagtcatctccaaatacggattggaggatgatacggtggactttatcgggcatgcgctagcacttcaccgggacgacagctaccttgacgagcctgcaatcgacactgtcaagaggatgaagctctatgcagaatcactcgcacgctttcaaggagggtccccttacatctaccctctatacggtctgggagagctccctcaggcctttgcccgcctgagcgctgtttacggtggcacgtacatgctgaacaagccagaatgcaaggtcgagtttgatgagagtggaaaagcgtatggagtcacttctgaaggggagaccgccaagtgcaagaagatcgtctgcgatccttcgtatttgccagacaaggtgaagaaggttggaagggtggcccgcgcgatatgcatcatgaagcatcctatcccggacaccaaggactcgcactccgtgcagatcatcctccccaagaagcagctaaagcgcaaatccgacatgtacgtgttctgctgctcctacgcccacaacgtcgcgcccaaaggcaagttcatcgccttcgtctccaccgaggccgagaccgacaagcctgagatcgagctcaagcccgggatcgacctgcttggccctgtagaggagaccttcttcgacatctacgacagatatgaacccgtcaacaaccctgacgacgactgctgtttcctcacaaatagctatgactccaccacccattttgagacgacggtcaaggatgtgctcgccttgtacaacaagatcactggaaaggagcttgatctctcagtcgatttgaacgcggctagtgctactgagcaagaagctgcttgaacaccccggcggcctctttttttgcagctctacacaatagctatttcttcgattttttttttaaaatgttccatagatggataagtttattgatgaaatccattattgtatgttttttggagttccgtttttgtcacatgcatgtaatgaacaacggtggcaatcatctataaaggttccattattcgctcgcga

SEQ ID NO: 8275 - DNA, 797 bp, Zea mays
gcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 8276 - DNA, 1128 bp, Zea mays
ggaaggtcttcgggaattctgttcagcagaatccgagtccactagccctcctcagtcctccccagggatttcgacttccccgagacaccatcgctacgacgagcaagcagagcaccatctcggctgccttaaactgtctctccgccggatactacacccgccgccgcagcgccgaccttgtctcaatcgagcggagcgggcgatcggattggttgcttccttcccccatctcatgttggtggactgagagatggagttttgatttcaaatagcatctagagaactgccactaagtttttaagttagtatataatgggtggctgttgttgctgttcgtcgagaacatctgaagccgatagagcaccaattgatatatatcgtcaacaaaatcttgaggagcatgagccgctgtcttcagcttttgatggatcatctccaccatcttcaattgttgcagtagacacaaatctggatacttccacacctgacacatatcgagcaccacctgcacccttgccttatgatgttgttttggcagtcccaactacccctggtttggagaagctagacaacaagagcaaaactgatgaccaacaagagtccataaatgatcaggagtctttaaaggtggatgagtcatgtaagaaaaatgtcactgaagataaggctgaggaggaggatgtttgtcctatctgccttgaagaatacgatgaagaaaatccccgctctgtaactaagtgtgagcaccatttccatctttgctgcattcttgaatggatggagcgaaaagatacttgcccagtttgtgaccagacaattttggtggatgagatgtccgaatagacttggtaatcctggtggatcatcacttgaagctgtttgttactgaggaagtgcaggcaacaactactacactcttgatattcgtccattctgggtggctctcagagtaatgaattgatggggcaaaaattgaaaggatgaacgacatgaaatgtatttacgccccctcctttaccctgcattctgtgtcatgcttttgctgttcatagcaacaggtggactaggaaactgcttggttgaattatatatagagagagatatgtcggcttgcaggttgattcagtt

SEQ ID NO: 8277 - DNA, 986 bp, Zea mays
cctcctaatcgcgaacgagcgtctttctcctccgtccgcgcccgtttgctcatcggttttgcctgccggtgggggaccgcctgcacgagcagcggctagccagacgtacggccttcgtttgaggctggagtcctgattggcaggtgcaagcacagagctcgatcgccatgtctttcaccggcacgcaggacaagtgcaaagcctgcgacaagacggtccacatcatcgacctcctcaccgccgacggcgtctcgtaccacaagacatgcttcaagtgcagccactgcaagggcgtcctctcgattagcagctactcttccatggacggcgtcctgtactgcaagacgcactttgaacagctcttcaaggagacagggaccttctcaaagaactttcaaggtggagcatcttcaaacaagaacgacccggcaaaggctccaagcaagctatcatctgcattctctggaactcaagataaatgcgcggcctgccagaaaacagtgtatccattggagaagatgactctggaaggcgagtcctaccacaagagctgcttcaaatgctcgcacgggggctgcatcctcaccacgtcctcctacgccgcgctcaacggggtcctctactgcaagatccatttctcgcagctgttcaaggagaagggcagctacaaccacctcatcgagacggcgcagaccaagaagaacgaggccgcggaggccggaccggagccaccggcggacgcaggcgcgggtgagccggaagcacccgcgcaatcggcgtagaacgtacaaagattagcagcaacgcaaagagaaatagagccgtacgtgtctatctcctctatatatacgaaccctgcattattagtaagtagtcgtcacaagtatatgttcttattttgtaaccttggcagcttggttcagtctgggattgtaacaagtgcatgttgaattgcttgttatgtattatgaggctttggattcatg

SEQ ID NO: 8278 - DNA, 1848 bp, Zea mays
ctcgttccatttccccatctcccagatccaattcgcgagttcttcctcctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaagacg

SEQ ID NO: 8279 - DNA, 965 bp, Zea mays
cacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggac

SEQ ID NO: 8280 - DNA, 1005 bp, Zea mays
ccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacgactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgacgaggatgacgagtaaagtttcgtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagtcgaac

SEQ ID NO: 8281 - DNA, 988 bp, Zea mays
ccaggccatcaggttatcgagaaagctctcgtctcttccatttctaggctagcctaggtctggaccagttaggcacgcaagtatcaatcgattcataagaggaggaggccattgagggagccaagtagaaggcagtcacggcaaaccacgtatcttgttgttagaaagctggtgagcaactttgtcaagcctcaagagctcatggaagatggcagtgctccaagacggtctactccacccgcccgcagaagcagatctgctgagttccacaatttttcagaaaggaggagaagggataagatcaacgagaagctgaaagcattacaggagcttcttccaaactgcaacaagaccgacaaagtttcgatgctagacgaagcaatcgactacctaaaatcacttcagctacagcttcagatgctggtcatggggaagggaatgtcaccagtggttccacttgagctgcagcaatacatgcattacatcacggctgaccctgcgcagttgcctccgttgcgcccctccggccagcagcaccggcaatttcagataactcaagccaatccccagagacaatctaacgtcgagtcggatttcttgagccagatgcagaacttgcactcttctgagccgcctcagaactttctcaggccaccgaaattgcaactttatacaccggaacagaggggtggcctacccagcacgagccacaacactggatggatttctgggagttcctcgtataacttcatggagtgatgtgctcctaatgacaaaatttgacacggcaagcgtgcaggcgtgcagccttgtactggcaagagattattcagtttgggacctgcagcatggttcacctgagagaattccatgaatgtgtagtactagttaactagctagctagttgtgttattaaataaaacgttgtgattgtgatgctgctcaaaaaaaaaaaaaaaaaaaaaaaaaaaaaaaaaaaaaaaaaaaa

SEQ ID NO: 8282 - DNA, 998 bp, Zea mays
gcgcgcgcgcgttctcacccgaccctgctcttcgcctcggctgctctaccagtctacctctaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcacgtaaatggactcatcatgtgaccactctattgttctttgtatttggtatttggtcattgtgggaaggcttcaaggaagatggagattcagaagaattggctgaagttgaagcagagctggatgctgtctttaagagtaataaaggcgaatctaaaactaaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggcggaatcatagcgcaagcactctgcactactgctgctgttcttggtggaaagagcctagcttcccagatatccgagaagatggtcgaactgtcaagcggagttctcttcctgctgtttggtatcatgtcattgctctctggaccaggagaattgtaatccctgcttgaacccttttcagctggctgattgacatatctctctccttagacctatcttatttcagtagatgaatgatggcgacaaaagccatccatccatatggcgaaccggatggtgattcgatagtttagccgacacatcggaaacatttcactcgtccttcataaataactacatgttacag

SEQ ID NO: 8283 - DNA, 1161 bp, Zea mays
gacctcgtagcgaatcggaccggggggctagggttccggtgcgcctctgcaatcggacgcgaggctaggctgggcatggagggaaccgctgcggcccggaagaggtcccggccggagacggcgaacggggctgccgccgccgggaagcgttccaaagacacggagtcatttcaaactggtctatcaagcaaatcgaagccttgcaccaagtttttcagtacgattgggtgcccgtttggcgagggatgtcattttctgcactttgtccctggtggttacgcggcagttgcaaaaatgctgaatctaagtagctctgctgtatctgcgccatcaagaactcatgtggatcatgccgctcttaccggtgcctctcatccagcttctacggtcaagacacgcatgtgcaccaagtacaacactacagaaggctgcaagttcggtgataagtgccatttcgctcatagcgaaagagagcttgcgaagccagcctacatgtctcaagaaggacctcctatgggtggtcgatatggacgagctgaacctatgcaaccagctgccatgggccctccagcaggaaactttggtgcctcggcgactgccaagatcagtgtggacgcctctctggccggtggcataatcggcaagggtggggtcaacactaagcagataagtagaattacaggcgtcaagctctccatccgcgaccacgagtctaaccccaacctaaagaacatcgagctggaaggcaattttgaccagatcaagcaagccagcgacttggtgcgtgatctcatcgcaaccatcagcgcaagcatgccagcgaaaaatccatctgctgccgcggcaccagcaggaggaggccgaggtggtggtccagggggcaagagcagcaactacaagacgaagctgtgcgagaacttcttgaagggtgcctgtacttttggtgaccggtgccacttcgcccatggcgagacggagcagcggagaggtgctgcatgagagtcgaggtgctctaggcaatgagatgccctgtgctctctccttttgctactgtgaattttcgccttgcagcgctaggcggttggactgttgtgttgtgttgcgacgtcaatggattaaactctagatttcagctttctttttttaacatataagttcgag

SEQ ID NO: 8284 - DNA, 945 bp, Zea mays
agatgatgcttagggtttccgcgtctccggccgccgcggtggccaaccatctctctggtggggccgcggcgaccacggctcctgccagggtgacggcgcagcgcagcggcgtctcgctgtccgccgccgccgccgccggcaaggggaaggaggtgctcagcggggtggtgttccagcccttcgaggagatcaagggggagctcgccctcgtgccccagtcccccgacaggtcgctcgcgcgccacaagttcgtcgacgactgcgaggcagccatcaacgagcagatcaatgtggagtacaacgcctcgtatgcgtaccactccctcttcgcctacttcgaccgcgacaacgtggccctcaaaggatttgccaagttcttcaaggaatccagcgacgaggagagggagcacgctgaaaagctcatggagtatcagaacaaacgcggaggcagggtgaggctccagtcgattgtggcgcctttgaccgagtttgaccaccccgagaaaggcgatgctctgtacgctatggagctgactctggctctggaaaagctggttaatgagaagctgcacagcctgcatggtgtggcaacaaggtgcaatgatcctcagctgatagacttcatcgagagtgagttcctcgaggagcaggtggaagccataaataaggtctccaagtatgtcgcgcagctgaggagagtgggcaacaaggggcacggggtgtggcactttgatcagatgctgcttcaggaaggggcctgaaggccaacaagggtggcgtggacggagctgagctctgggtggtgtattcttttctttttcttttctttccagttggttagtgttttagttgtagaacggtgttgcgttgcccacatgacatgatggatgttacgtggaggattgtctcttatatttgaacattatattgtcgttcgtttttggc

SEQ ID NO: 8285 - DNA, 765 bp, Zea mays
gttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8286 - DNA, 978 bp, Zea mays
gagattagctcttcaactagtcgcgctgtcacggtgccgaacagcgtgtcatcgccttcccctccctacaagccaaacgcgaataccacccccgtgacttcccgatctccggcgatggccgcgcggcgcctcggatcccccgcatctaggtggctgcgcccgtccgcgctgctcctcctggtcgcctctgctctcctctcggccccgtcgccggcccgggccctccggttcgacctcgagtccggccacaccaagtgcgtctccgacgagatcaaggtcaacgccatggccgtcggaaagtaccacatcgtcgggcccgaccccaactcacccgacgcccagctccccgagtcgcaccgcatctccctcagggtgacgtcgccgtacgggaacagcatgcactacgcggagaacgtgcagtcgggccacttcgccttcacggcggcggaggccggcgactacctggcctgcttctgggctcccgaccacaagccgccggtcaccatcgggttcgagttcgactggaggagcggcgtctccgccaaggactatcccagcgtcgccaagaagggcaaggtcgatatgatggaattggagctgaagaagctagaggaaactataaaaaatatacatgaagagatgctttatctgcgtgaaagggaagaggaaatgcaggacgtgaacaggcgaacgaactcaaggatggcttggctagggttcctctcccttggcgtctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttgaaatcccatgtaacaaacggtatgtcgtacttgagaaaatatgctttagcctgtccagttgaaattctaagaaacttgaaatagatact

SEQ ID NO: 8287 - DNA, 592 bp, Zea mays
cgcacatatctactatactatactctaggaagcaaggacaccaccgccatggcagccaagatgcttgcattgttcgctctcctagctctttgtgcaagcgccactagtgcgacgcatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccaaataatgagttgacatgccatcgcgtgtgactcattattattaacaataaaacaagtttccttttatc

SEQ ID NO: 8288 - DNA, 682 bp, Zea mays
gtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtcagagctcgttgtgtact

SEQ ID NO: 8289 - DNA, 1526 bp, Zea mays
ccctcaccctggtctggtctcctctccaagcgggcagcgctcctccaaactgaaccctatcctagcacgagtgcacgtcggtggcagcaggagatggtggggacggcggaaggcggcgcggagagggcggtgcggcggtgggtggacgccgccggcgggcgcctggtcctggacggcgggctggccacggagctcgaggccaacggcgccgacctcaacgacccgctctggagcgccaagtgcctcctctcctccccgcacctcatccgcaaggtccatatggactacctagaagctggggcgaacattataatcacagcatcgtatcaggccactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaattggaagctcaggcatatgttgaactccttgaggaatgtaacatcaatatcccttcatggctttccttcaactcaaaagatggagtgcatgttgtgagtggtgattcgttaattgaatgcgctactattgctgacaagtgtgcaaaggttggtgcagtcgggataaattgcacacctccaagatttattcatggactgatactctccattcgaaaggtcacagacaagcctattctgatatatcccaacagtggtgaaagatatgatggtgaaaaaaaggagtgggtggaatccactggtgtgtcagatggtgattttgtttcgtacgtaaatgaatggtgcaaagatggggctgcgcttatcgggggctgctgcaggacaactccaaacactatcagggccatacacagaactcttaaccaaggctgccacaagcatcagttacctgtagcatagatctgtgctccactcctgatgctctcctcccagcagtaccttgagctgtatccccgagattccttaaccagcgcgaaccaatatactgttgcgtgttctcctgcaaatgagatgttctgcacctatgtttgtaatgttgtatttctgggtttttaagctatccaacttggagatacaaccggtgaggaagcagcaacaataggtagttctacttctgagtgaggaaaaacaacttgcggctgagttaatgaagcttagtagctaccaccgttgtatgacagttgctcagagatgttatcttcattaagtgcttatattaccgctagttcgctgtgaaatttgttaaaccattatatgtaagttttgtttgacaagactgcatctcctgaaactaagatcttagtttcctgctaaaa

SEQ ID NO: 8290 - DNA, 719 bp, Zea mays
gcgcgacaaaggttacctttcctttagtttggaccaatacctgctgcagccaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgacgggaaatggggggagcatgagcttgactacctgctgttcatcgtccgggacgtgaaggtgcagccgaacccagatgaagtcgctgacgtgaagtacgtgaaccgcgacgagctcaaggagctcatccggaaggctgacgctggcgaggacggggtgaagatctccccctggttcaggctggtggtggacaacttcctcatgggctggtgggaccatgtcgagaaaggcaccctcggcgaggccgtggacatggagaccatccataagctgaaggagtgaggggccgccggccggccggctccgatgacctcaccacctgttgatgttgctgctgctgctgcactgcatgtttatcaaaagttatcgctcctgctcgcggaaagtgagcttgactgttgccggggtggaagtgtcgttttggactgaagatgagtgccgcggaggggtttgttgtttgtttgtttgtttgttcggtgaccgaatcgcgagttggacgcctgtttaatc

SEQ ID NO: 8291 - DNA, 769 bp, Zea mays
gcggtttctctccctcccttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtatcctgtctatgttgtctagttcgccagcaaagcaacgtccagtggacaatgaccgctatgtcaggaactgccgcaacgggaggtcgccgaaggagaccagatggtggttccatgacgacacggtgtaattgagcgcctgtcagccttccttgctgtggtatatctcgtcaaggggagattggggatgatttaggcctatttgtaagcatccctctatcggattgcgaagcttaccttcctgtggcggtgtgttaaatgagttgcacacatgtgtcgagtctgagaatacatattaccatcatcaatgatataagtaatatag

SEQ ID NO: 8292 - DNA, 826 bp, Zea mays
gggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8293 - DNA, 1558 bp, Zea mays
gctgctaggtggttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcctat

SEQ ID NO: 8294 - DNA, 1578 bp, Zea mays
gcggggatcacggcgccgccctgcccctcatcgcggaccaggcgaaacatgccgccgccggtggcatcgtccgaagcgggagcatgtggacggcagcggcacacgtgatcacggcggtgatcgggtccggcgtgctgtcgctggcgtggagcatcgcgcagctggggtgggtggccgggccggccgccatgctcgtcttcgcggccgtgacggcgctccagtccacgctcttcgccgactgctaccggtcgccggaccccgagcacggccctcaccgcaaccgcacctacgccaaagccgtggaccgcaacctaggtagcaacagctcgtgggtgtgcatgcttctgcagcacacggccctgttcggctatggcatcgcctacaccatcacggcctccatcagctgcagggcgatcctgaaggcgaactgctaccacgagcatgggcatgacgcgcactgcgactacgatggcaactactacatgctcatcttcggcggcgtccagctcctcctctccttcatacctgacttccacgacatggcgtggctctccgtcgtcgccgcggccatgtcgttctcgtacgccttcatcggcctcggcctcggcctcgcaagaaccattgctaacgggacgatcaaaggaagcataacaggtgttcggatgaggacgcctatgcagaaggtttggcgcgtctcgcaggccatcggcgacattgccttcgcgtacccctactccttgatcctcctggaaatacaggacaccctgaagtcaccgccggccgagaacaagacgatgaagagggcgtcgatgatctcgatcctcgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcgggcgtgccgggtgaacccgctgcgcgtgtgcctccggacgctgtacgtggcctccacgacggcggtggccgtggcgttaccctacttcaacgaggtgctggcgctgctgggcgcgctcagcttctggccgctggccatctacttccccgtggagatgtacttcatccagcggaacgtgcgccggtggtccgcccgctgggtcgtcctgcagaccttcagcgtcgtctgcctgctcgtcagcgccttcgcgctcgtcggctccatcgaggggctaatcagcaagaagctaggctaggctaggctagtccgatccagtggaacaccctatctgcaggtctgtcagagagtggcagcgggctcggttattttcacagtgttgccttcctcctgcatcgggttgtaagttgtaacatatatgtcgtattgatactggcgagttcagatgttcagaagaagtagaacgcgtgtgacgattctgtgtt

SEQ ID NO: 8295 - DNA, 1475 bp, Zea mays
agccagacaggcagctcacgtgtgcaggcagcggccaagatgatggcggaggcgtggacgccggtgccgttcccgccgacggcgccctgcttctggctgcacgacacgcactcggttttctggcggggaggagacgcgtggacggcggcggagaacaaactgttcgagaaggcgctggcgcagatcgaccgtaacgcgcccgacaggtgggagaaggtggcggaggtggtgcgcacgaagacggtcgacgacgtgaggaaccactaccacgacctggagaacgacgtcggcttcatcgaggccgggctcgtgccgttcccgcactacagcggctcggttccgtcgttcgggttcacccacgaggattgggacggagggttcaggcgcggctactgccttaagcgcgcgcgcggctccgacccggagcggaagaagggcgtcccctggacggaggaggagcacaagcttttcttgatgggactgaagaagtacgggagaggggactggaggaacatctcgcgcaagtacgtgacgacccggacgccgacgcaggtggccagccacgcgcagaagtacttcatccgcctcaactccggcggcaaggacaagcgccggtccagcatccacgacatcaccaccgtcaacctccccgacgaagaccgcggcaacgcgccgccgtccgcggtcaccaccaccaccaacccctccgtcgccctcgtggacatgaagcccttcgttgcgccgtcgctcggcgtgccgcacccctacggcgacgtgaagctggagcctaagagctcgctggtggccggcctgggcttcaacgactccgtcctcctgatgcactgcggacagttgtaacgggctgttcttgcggcgagaaccgctcccgtcgcaacgtacgccaccaaccaccacctcatctatccccgggcgggcatcagggccggcggcacaagtcgcacgtcgtcgtgctaggcttggatgcagagttgcttcaggtgtactcctaccgatcagatggctggcacgtcccgccgcgtgtgacgaggatgaagagtggaacagtctcgtcgtccagctgccagctcgcggcagctccgagtggctgtgttgtgttcatcgagaacaagaggccatggcccatgggcgtacgcgtgccgttccagcgtccatttcggttcagtgtacaaaattcgacaagtacagagtccaacaacttccacggtaccgaacaataaagcattcgataaaaagcctcttccagcgtcaccggcggcttggattaggatccaggatcagaagatttctgtaccggcttaattgttaatgtatttttggtgtgtgcaacatctcccaccagatggtgttaacacttgtagtgtgtgatgcttgtagtggggtctcgcaaggtttttgtccgccattgttgctttgccagttactagctagtagaagtttagacatgatgttctatt

SEQ ID NO: 8296 - DNA, 921 bp, Glycine max
ggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccatt

SEQ ID NO: 8297 - DNA, 667 bp, Zea mays
gaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgtccttgtgtcttattgtatgttcgtcttcatcgagaagatcttcagcaatcagagctcgttgtgtact

SEQ ID NO: 8298 - DNA, 705 bp, Zea mays
ctccaaacgcagcagagcccctagcgccgccggtctcttcagcctcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggcgccaccgccgccgtctattccgccgccatcctcgagtacctcaccgccgaggtcctcgagctggccggcaacgccagcaaggacctcaaggtcaagcgcatcaccccgcgccacctgcagctcgccatccgcggggacgaggagctcgacaccctcatcaagggcaccatcgccggtggcggcgtcatcccgcacatccacaagtcgctcatcaacaagaccgccaaggagtgaatccaggccgtgctgctgcttctgcctgactacagtcccatctcgttctgtacttgtgctatcttagtttaagtgcatgttggcacagttctagtaaactcatcttgttcacctatgttaatttaagctctcttccgcgagctttttggattgctggtatcgtgattaacgggttcgtaaaattagt

SEQ ID NO: 8299 - DNA, 662 bp, Zea mays
aacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatgccgtgtttctt

SEQ ID NO: 8300 - DNA, 795 bp, Zea mays
atccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttg

SEQ ID NO: 8301 - DNA, 683 bp, Zea mays
cccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaaggtctgggcgtgcgctcgaagaggttcgctctcctggccgacgacctcacggtcaccgtcgcaaacatcgaggaaggcgggcagttcacgatctctggcgctgaggagatcctgaaggcgctttagaagccgcagcaacgatcggtctagtttgaactcgcctttgaataacttgtcgttggacaaggtctagttcggtgttgtgtatggaacggtcgtcactgagtcatgcacgatttggtatccgtgtgtttatgttcgccggtttgaggaactctctgatccgtcgtgacac

SEQ ID NO: 8302 - DNA, 1509 bp, Glycine max
caattgcaacatactaagtgggttggctggtttagatctgagcaacagcttttaattttctacttgcttgaattttattggaagccatggattgttcatcatggattaacacttccttggatctcaacattaatccccgcagagttcatgaagaagttcccaaggaggtagaaagcgagcttttctctttgggaatgaccaagtttaacgtggaagaagagtctactagtgacttggaggaggaactgaagcgggtgactgcagaaaacaagaagttggccgaaatgctctcagtggtgtgtgagaactacaacactttgagaaaccatttgatggaatgcatgaggaaaaatggtgaaaaggaggtcagcccaacatcaaagaaaagaaagtctgaaagcagcaacaacaatagtaatttgatgggaactaacaatggaaactcagagagcagttctactgatgaagaatcttgcaagaaaccaagggaagaaatcatcaaagcaaaaatttcaagagtttatgtcaggactgaagcatctgatactagccttattgttaaagatggataccaatggaggaaatatgggcaaaaggtgaccagagataacccttgtcctagagcatatttcaagtgctcttttgctcctagctgccctgtcaaaaagaaggtgcaaagaagtgtggatgatcaatctgttctggttgctacttatgaaggggagcacaatcatcctcagttttcttcccagatggaagcaacatcaggttctggccgtagtgtgacccttggttcagtgccctgtaccgcatctctcagcacttcaacaccaacacttgttacccttgacttgacaaaatctcagggaagcaacgattccaagagcacaaagcctaaaggagattcacctaaagtacctcaggttttggtggaacagatggctacttctttgaccacggatcctaattttagagcagcacttgttgctgccatctcaggaagattgttgcacaataattaaatggaattttggtgaagtgttgctaatttagtgtcaattgtttaagtattccataaaatagagatcattctttagagcaaggggtctctctatgtaaatacaacatggaaggctgggacatatttgatcctttaaagtggaaataaagttccactaaggatgacatgttgagctgattaaacaacagaaaatcaagctctgcaccaccctctgcctcatcatgatggtaaagatttagcaagtcttttttggctaatatatctaggatacctcaaattaaatttcatagtaggttgtagcacacattctcggaaagatctttcataaagtgcatctctacggcaatttaatttctcccttttcttctctcactactctctctggcaagccaactctatatctagtcctagttttagaatttcatttcagaaattatattatacattgatcaagtattataagtgatggaatgtaactcaaaacatgg

SEQ ID NO: 8303 - DNA, 1222 bp, Glycine max
gctgcaccatcgtcctgcatgtcagaggtccagagggtgaggttatcacacacactttctctctctctctctctcacccagatcttgtagcaatggcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccattatgatgctgtttagaatattaccaagatgttgttctctttagcaaacttcgtattgctcattattttaggatgcgaaggtgtgacacctttcatttgtttttattctaaagcctcggaatcataactct

SEQ ID NO: 8304 - DNA, 1209 bp, Glycine max
agttaacgtagaaaagcttcgtctcttgtcttcgcttctttcaattccttttcctttctatctctctctcttcttatatttccacattccacgtgaaccttctagaactataatagaaagaaaccctccattccatggctccgccgctcgaacacaacggcgtttccacgagcggtgactctcagagatccattcccacgccgtttctcaccaaaacctaccagctcgtcgacgatcacaccatcgacgatgtcatttcgtggaacgattctggatcgtccttcatcgtctggaacaccaccgctttcgccaaggatttgcttcctaaatatttcaagcacaacaacttctccagcttcgttcgccaactcaacacttatggatttagaaaagttgtacctgaccgctgggagttctcgaacgagtattttcgaagaggcgaaaagcgtcttctctgcgaaatccagcgacggaagatcctctccgcatctcctccgccggcgggagcaactgccaccgtggcggttccgtcgccgctgccgctatctgcgatcccgacggcgaagccgatcgtgtcgccgtcgaactccgcggaggagcaggtgctttcgtcgaactcgtcgccggcgagagcaccggtggagctgttggacgagaacgagcggctgagaaaggagaacattctgttgacgaaggaattggtgaagatgagatcgctctgcaacaatatattcaatctcatgtcgaattacgctaacgctcaagcggacggtagttccgcggcggcggcgaagcggtgctccggcgaggatgcggtggaggagatgaatccgaagctgtttggggtggcgattggtaagaagcgagcgagagaggaggaaggacatggagcgaagtatgatacggctttgagtctgcatcagccgtttcatgcggacgtgaaatctgaagcgttggatttaccaggacgtggcgaaaataaaaaaacgccgtggctaaatcaatgtcatagagcaaatcagagggtgtgtaattgacacacgacgttgtaatagctaggtaacacgttaggttaagttaggggcgtcgtagagaatcagagtctgtaagcacggagacgcgcgtgtcaaatgtacgtcgttaaccgtttgggacttttttcgtagaagtttctcagaagaaaactatattttgttgttcatttccttt

SEQ ID NO: 8305 - DNA, 1409 bp, Glycine max
gaagaagagagagacagacagaacaatgggggaagcaaagggaaaggaagaagaagtgttagcctcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgctagattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaatgtgttgtggacaccatctaagttaatagctcgattgggaaaagaaataaaaaatgaaagctcttacctttactgggcatacaagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacactgtgatgcaacaatagcatttcctctgctggttgctgaaacgtttgcttcaaaagtgaaacctccccattgatgaaggttaaagatgaatttactctgaagttcattttaattgtgtgtgtttgaggatcttgatggacaagttcggcattggtgttcaatttgactatcatttgattcctaagctcctcttagcagtggagacctttttgaccattcaaaggtaatccattaatcctgtcagtgaggaagtcaggaattatagatgtgaggatcattgtactaatatctttagggaaaataaggctaagaaaactaactgatcatatatggcatttttaatattttcc

SEQ ID NO: 8306 - DNA, 515 bp, Glycine max
agaaaacctaatttctcaaatttgatttcgcaccaaattttcctcactaaaatgtctggtcgtggaaagggtggcaagggtttgggaaagggaggtgccaagaggcacaggaaggttctgcgcgataacattcaaggaatcacgaaacctgcgattcgtaggttagcgagaagaggtggcgtgaaaaggatcagtggtttgatctacgaggaaaccagaggagttctgaagatattcttggagaacgtgattcgtgatgctgtgacctacactgagcacgctaggaggaagacagtgactgctatggacgtggtttatgctcttaagaggcagggaaggaccctctacggttttggaggctgaacaattctttttttggctgtgctcctatgtgcttgttctcttggatgctggtgatgtttaggttcatcctgtaacataggcttattcagctctagatgtaaaacgttgaaccgtaattggaattatatgaattagtacttttttgttggtgg

SEQ ID NO: 8307 - DNA, 1743 bp, Glycine max
agataatcggaatttagtagttagttcggtttttagttacttaaccgcttaacgatataaataaataaataaaaagaagcgcgacgatgttagatcttaatctcaatgcggagtggaccgattcgtttagtaacggtgagtcgccgttaccgttagagaagtttccagacggtttgaggaaccaaatggccgagtcagggacttcgaattcctccgtggtgaatgcggacgggtccagtaacggcggcggcgacgaggactcggactccacacgagctgctgatgacgtgtacaccactttcaatttcgatatccttaaagtcgaaggcgcgaacggcttcgtaacgaaggagctctttccggtgatgagtgaaggagctaaaggacacgctacgtcgtcgttttcagggacgaatggtttcgtggatctctcgttcgatggcgatggagggaacactagtgagatgaagatgcttcagcctcagaatcagaatcagactcaaacgcgaactcagacacagcaaccagcgaaaaagagtaggagaggaccgaggtctcgaagctcgcaatacagaggggttactttttacagaaggacgggaagatgggaatcgcatatctgggattgcgggaaacaagtctatttgggtggatttgacacggctcatgctgctgccagagcctatgatcgagccgctattaagttcaggggagttgatgctgatatcaatttcaatctgagtgattatgaggatgaccttaaacagatgcagaatttgtccaaggaggaattcgtacatatactgcgtcgccaaagtactggtttctcaagaggaagctctaaataccgaggagtaacactccacaagtgtggccggtgggaagctcgaatgggacaatttcttggcaaaaagtatatatatcttggactattcgacagcgaagtagaagctgcaagggcttatgacaaggcagctatcaaatgcaacggaagggaagcagtgaccaactttgagccaagtacttatgaaggagagctgaaatctgcagccattaatgaaggaggcagtcagaatcttgatctcaatttgggcatagcaaccccaggacctcccaaagaaaattgggggcaacttcagttcccctccttcccttacaatacacatggtggaagaagttcaatgatggaaaccaatgttagttctggaattggtaatccatctttgaaaaggatggttgcaactgaagatcgtccttcattatggaatggcatgtctcctaatttctttcccaatggggaaagagcagagagaatcggcgttgatccttcaaacggactccccaactgggcgtggcaaacacatggccaggtcaatgctaccccagtaccaacgttctctgctgcagcatcatcaggattctcaatttcagctacctttccatcggctgccatctttccaacaagttctatgaactcaattccccagagtctctgttttacttcatccagcatgcctacccgcaatgcatctgaatattattactaggttaagcccccacaggcaccaccatagctgattttgcagtacagattaaagacaaactaaaacaaaagtgttttcggtccaaattctttttataattcagccactgattggtgtatactgagattcgacaccttattgctgtctcttgcttaaactataatgccccatgtttggatacatcatctttgaagcaaac

SEQ ID NO: 8308 - DNA, 634 bp, Glycine max
cgcttctgattattcctcttcccattctagggttcccaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctgttggctgtaaggaacgatgaggagttggggaaattgcttgctggtgtcaccattgctcatggtggtgttcttccaaacattaaccctgttttgctacctaagaagactcaggttgctaaggaaccaaaatctccatccaaggctaccaagtctccaaagaaagcttagatgtttttattttattttaatatatgtatatcagtgtttagatgctttttatgtaaaagaaaatagtatctgttggaaacactgtaattcttatcgtcttgcatgtaggagtttgctaaataatgaaaatatcttattattttgggtc

SEQ ID NO: 8309 - DNA, 612 bp, Glycine max
agagtacaaccttttcaactccgaaggcgagccacgatgtcaggaagaggaaagggaggcaagggtttgggaaagggaggagcgaagaggcaccgtaaggttctgagggacaacatccaggggatcaccaagcctgcgattcggcgcttggcgaggcgtggcggcgtcaagcgtatcagcggtctcatctacgaagagacacgtggcgttctcaagatcttcctcgaaaacgtcattcgcgacgctgttacttacaccgagcacgctcgccgcaaaaccgtcactgccatggacgttgtttatgccctcaaaagacagggcaggaccctttacggtttcggtggttagttaggacattatggtaggctcttactcttattagtatcgaatcatatgttgctagatggatcttcacattgtaatggctgttgttgtttaatttctgttcccagcttatttttcttttagccgcgcttattaactgatcacttcttttgagtgataatgtgactagagatttttatttatttatttatttctgggtattgcgaacttgagggtggaaacattattataaaatgaaaaggagtgcgtcgccgtttgcattgaatc

SEQ ID NO: 8310 - DNA, 602 bp, Glycine max
aaattcgatttcctaccaatttctctcgagaaaatgtctggtcgtggaaaaggtggcaagggtttgggcaagggaggcgccaagaggcacaggaaagttcttcgcgataacattcagggtatcacgaaacctgcgattcgtaggttagcgagaagaggtggtgtgaagagaatcagtggtttgatctacgaggaaaccaggggggttctgaagattttcttggagaacgtgattcgagatgctgtgacctacaccgagcacgctaggaggaagacggtgactgccatggatgtggtttatgcgctcaagaggcagggaaggaccctctacggttttggaggctaaagaatttaacccttcttttctgggttgcaggataagacattggttcttttgaatttgcgtggtgttttagtttaggtttgttatgtatcatacgaatctctggtttgcatagaaaatatttcatttgaaatttaaatggagtatcgtttctgttaggcatattatttcggctaaattagtttttttttcttctattctattttattatttaggtgtaatttgtttttttttatgttttgagattcaaatgatgattt

SEQ ID NO: 8311 - DNA, 692 bp, Glycine max
aacacattaacctttctcattccccatctcctcaccttattcagccactgctaatttctagggttccgaaatggacgctggcggaaagatcaagaagggcgccggaggaagaaagggcggcggccctaagaagaagccggtttcaaggtccgtcaaggccggtctccaattccccgtcggaagaattggccgttatttgaagaaaggaaggtacgcccagcgtgtcggtaccggtgctcccgtttacttggccgcagttctcgagtacctagctgctgaggtgcttgagttggctgggaatgctgcacgtgacaacaagaagaacaggattattccgagacatgtgctattggctgtgaggaacgatgaggagttggggaaattgcttgctggtgtcaccattgcacatggtggtgtgcttccaaacattaaccctgttttgttgcctaagaagacggagagggctgccaaggagcctaagtctccatccaaggctactaaatctcctaagaaggcctagattatcctttttttttttttttttttaaatctagtgttgtatatcggtgcttagatgcttttggtgtaacaggaaatttgatgtgtttcttaaacattgtaattcttgtcccattgtgttgcttgtaggagtgagtttgctttattaatgaaaagtggaaacctttgttttc

SEQ ID NO: 8312 - DNA, 1757 bp, Glycine max
ggaggcacaacagctactccagctcttttgcattgcttgtagcagaagctgctgctgcagcttattaaagaaagaaagcctccaagacaagatggttgagaaggatggcgttggcagcaagtatcttcaacaaacacttaacgtctccatcgacatgcatcaacacggaatctctaagtgtttcgacgacgatggtcgcccgaaaagaaccgggacggtgtggacttcaagtgcacacataataactgcagtgattgggtctggggtgctatctctggcttgggctatagctcagcttggatggattgctggtcctattgtcatggttatcttttctgccatcacttactacacttccactcttctcgctgattgttaccgcaccggtgatcctgtaactggcaagagaaactacacttacatggacgctattcagtctaactttggtggaaatggctttaaggtcaagctgtgcgggctagttcagtatgttaaccttttcggagtggccattggttacactatagcggcttccactagcatgatggcaattgaaagatctaattgtttccacaagagtggagggaaagatccgtgccacattaacagcaacatgtacatgatttcatttggtatagtggaaattcttttctcacaaattccgggcttcgatcaactgtggtggctctccattgtagctgctgtcatgtccttcacatactccactattgggctaggccttggtattgggaaagttattgaaaatggaggagttggaggaagcctaaccgggataacaattggtaccgtgacccaaactgataaagtttggagaaccatgcaagctcttggtgacatagcctttgcttattcatactccctcatccttatagaaattcaggacacagtgaaatcccctccatcagagtcaaaaacaatgaagaaggctagtttcatcagtgttgcagtaactagcattttctacatgctttgtggttgctttggttatgctgcttttggagatgcaagccctggaaaccttctcactggttttggcttctacaacccatactggctccttgacatagctaatgctgccatagtgatccaccttgttggttcataccaagtttactgccagcccctcttcgccttcgtcgagaaacacgcggcgcaaatgttcccagatagtgattttctgaacaaagaaattgaaattccaatccctggtttccatccctacaggctcaacctcttcaggttggtttggaggacaatatatgtaatgttgagcactgtaatatcaatgctcctcccattcttcaatgacataggtggacttcttggagcatttggattttggccccttacagtgtatttcccagtggagatgtacattattcaaaagagaataccaaagtggagcacaaagtggatctgcctccaaatacttagcatgacttgccttttgatgactataggagctgcagctggctctattgctgggattgccattgatcttcgaacttacaagccattcaagaccaactattgattaaactatgattgccattgatagagatttcagaaaccaaatttcatttcttggtcatattcttatgaagccaaggatatatggtgatcttgtttgtttatggcctagcagtcctgtgtgttccacttctttctactgtgtatctgttactctctagctcgttctgcaacctaattcaaaatggaagaaatgaagtaaaaac

SEQ ID NO: 8313 - DNA, 1290 bp, Glycine max
cgagaagacgacagaaggggaaaaaggatgaggtagagagaaggtgggagtggcagagagaagattacaaagaaatggggagatgggtgaattgtaggggcaatatattcccattcctggggatggtgatggctatgctagctcaaagtggaagcatggtggtaatcaaagttgccatgactgatggaataaacaaatatgtcatggttgtgtactctttggcactctccaccatcttgcttcttccctttgccttgtttcttcacaggtcagagcgtcctcctcttacattctctgcactttgcagtttcttcttgcttgcattctttgggagttcaggacagataatggcttatgttggcatagatctaagctctcctactcttgcatcagccatgcttaatctcattccagctttcacttttatacttgctctcatttttaggatggaagaagtacattggaaacattccagcagccaagccaagttcttaggaacaatagtatcaattgctggagcatttgttgtgatactgtacaagggcccacccatctttaagacacatttgtcaaactcttcgaacaaatttctattttcgcagcaactaaactggatcttgggagggatgttctgtgctggcgattctatagtttgttccctgtggtacatatatcaggcttcggttgcatacaaataccctgctgtaacaaccatagtattcttccaactcttattttcaaccattcagtgtggagtatttgccttaattgtagttcaagatcaaacggaatgggagctgaagttagatattgggttgattggcattgtatatcaggcaattgctgcaacattgatacgttacatcttatgcacgtggtgcgtccttaaagctggacctctgttctgttctatgttcaagcctgtggcaatcatcttctccgttttcatgggtgcaatttttctcggggatgacttaagccttggaagtttgattggtgcggttataatcgtgataggattttatgccgtactgtggggaaaatccatagaagataacaagattgagaaaggggttgagaacttggagtcatcgtgccataatgttcctttattacaaaataggacgtaacaggtaggttgaatatttgacatggagaacaatgtgatattgcaaaacacttaaaaagttagttagaagttgtaatgtttatgtattggtttttcatgtatctatttttaataataataatatttttgagaaaaatgttttccaaaaatattttttagcc

SEQ ID NO: 8314 - DNA, 1248 bp, Glycine max; identical to SEQ ID NO: 105

SEQ ID NO: 8315 - DNA, 1321 bp, Glycine max
ggaagaaagagagagagagagagagagagaggtgtgaagttggtgaaggtttttgagaagaaagatggaacgaagtggcggaatggtaactgggtcgcatgaaaggaacgaacttgttagagttagacacggctctgatagtaggtctaaacccttgaagaatttgaatggtcagagttgtcaaatatgtggtgataccattggattaacggctactggtgatgtctttgtcgcttgtcatgagtgtggcttcccactttgtcattcttgttacgagtatgagctgaaacatatgagccagtcttgtccccagtgcaagactgcattcacaagtcaccaagagggtgctgaagtggagggagatgatgatgatgaagacgatgctgatgatctagataatgagatcaactatggccaaggaaacagttccaaggcggggatgctatgggaagaagatgctgacctctcttcatcttctggacatgattctcaaataccaaacccccatctagcaaacgggcaaccgatgtctggtgagtttccatgtgctacttctgatgctcaatctatgcaaactacatctataggtcaatccgaaaaggttcactcactttcatatgctgatccaaagcaaccaggtcctgagagtgatgaagagataagaagagtgccagagattggaggtgaaagtgccggaacttcggcctctcagccagatgccggttcaaatgctggtacagagcgtgttcaggggacaggggagggtcagaagaagagagggagaagcccagctgataaagaaagtaaacggctaaagaggctactgaggaaccgagtttcagctcagcaagcaagggagaggaagaaggcatacttgattgatttggaaacaagagtcaaagacttagagaagaagaactcagagctcaaagaaagactttccactttgcagaatgagaaccaaacgcttagacaaatattgaagaacacaacagcaagcaggagagggagcaataatggtaccaataatgctgagtgaacataatgtcaaaagatggcagagaaaacttatagatggaatagatttagaaagagagaatacattagccagaaagagaaaaaaaaattggacattagttgatgattctttctaggtgtgcgtttggaatacaatgaagtaaaggatgaaccttaagacatgctttatcctaaaatagtgtgatctgatattccattgttaatgagtaatgtaattatcatacaaacaatttgtagtctcattttaattaataattattaaactacttgattacttatggtc

SEQ ID NO: 8316 - DNA, 808 bp, Zea mays
gtagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaagg

SEQ ID NO: 8317 - DNA, 764 bp, Zea mays
ttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8318 - DNA, 1165 bp, Zea mays
cgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 8319 - DNA, 826 bp, Zea mays
gggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgc

SEQ ID NO: 8320 - DNA, 813 bp, Zea mays
gcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacaacaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacaactaccaccattcagccagctagctgatgtgagccctattgccttcttgacacagcaacagttgttgccgttctacctgcacgctgcgcctaacgctggcaccctcttacaactgcaacaattgctgccattcaaccaacttgctttgacaaacccaacagcgttctaccaacaacccatcattggtggtgccctcttttagattgcttatgagttatagttcaataatgaagttttttggatgatgtttgtggcttcccagaaataagaaagtacatttct

SEQ ID NO: 8321 - DNA, 825 bp, Zea mays
ggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8322 - DNA, 572 bp, Zea mays
ctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttactctgattccatctcgcacattatacaacaacaacaattaccattcatgttcagccccacagccgtggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctc

SEQ ID NO: 8323 - DNA, 797 bp, Zea mays
tggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaagg

SEQ ID NO: 8324 - DNA, 909 bp, Zea mays
cctcccccacttttgctgctgctggttggttggtttgcgtttgttcgggcagctagcgtttcctggattggggacgcttccgtttcgggaagccgtgaagggatcggccacgacgatggtgcgggggaagacggagctgaagcggatagagaacgcgacgagccggcaggtgaccttctcgaagcgccgcaacgggctgctcaagaaggccttcgagctctccgtgctctgcgatgctgaggtcgggctcgtcgtcttctccccgcgcggcaagctctacgagttcgccagcgccgccagcctccagaaaacaattgaccgctacaggacatacacaagggaaaatgtcaataacaagactgttcaacaagatatacagcaagtcaaagcagatgccgtaagcttggcaagtagactcgaagccctagaaaagaccaaacgaatgtttctgggtgaaaatttagaagaatgctccattgaagaactgcataatctggaggttaaactggcgaagagccttcacgtcatcagagggaagaagacacaactgctggagcagcagatatccaagctgaaggagaaggagaggaccctgctccaagacaacaaagagttgcgggataagcagcgcaacctccagtctccaccggaggcgccaccggacctgaaccgctgtgtccctccttggccgcgtagcctgccggcaccgagcaatgacatggacgtggagacggagctgtacataggattacccggcagggagcgctcctccaaccgggactctgattgaaccacggattttcagttcgatcggctaaaaggaataagctccctgaaattaaagcatcgaagggcacacgtcaatggttttatttgcaacttttgtatgcaaacttgtacttgaaaagt

SEQ ID NO: 8325 - DNA, 800 bp, Zea mays
atccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgatcttagactcccaactgatgagactcttgtggcccagatcaaggaagggtttgaaagtggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatgtcaaacacaagtgcagggatcgctgggtgttgcaccgtgtctgcattatctgtggttacattctggaccctgtattttctatgcttttatgcccctactgtttagtattaattatcaataaatttgtttgggacggttgaattgc

SEQ ID NO: 8326 - DNA, 769 bp, Zea mays
ctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgttggatggcagcgtggccatcagcagcatgcagtcgtcgtcgtcgtcgtcgtagcagatgtcctagctacgtgtgcatgtcatcagactggcacatatataataaagaagtagatcatgcacccactagtgatcacttcgtctagtgtcccctgtcgtcgtcgtcgtcgtgtacctcgtacgtgacatgccgtagcacgtacgctagcagagcagcacctcaatgtccttgggtttgctttgctggctctctgttttcgtctctcgtgttgcttttaatctggcacaggtttctaaattat

SEQ ID NO: 8327 - DNA, 748 bp, Zea mays
tcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctgccgtgatgtttaccctagtccagagggtttatcttcgttcgtctcgtgtttgttgttgcccatctgtgtttttgattgcaaggtcgctctgtgtcagttgttagtgctgtgttcatcctcggctccagcagacccatgcatcaaacagcatggactgcggatcgatggatgctgttacccccgtcaggctttattctaagttaatcttaaggaaaaaatggtgcttcttggtgctgc

SEQ ID NO: 8328 - DNA, 761 bp, Zea mays
cgcgatctagaccttggtctttctgcaagtgttgctaccgcaaccattttcccacaatgctcacaagctcctatagcttcccttctttccccatacctctcaccagcggtgtcttcagtgtgtgaaaacccaattgttcaaccctacaggatccaacaggcaatcgcaacaggcatcttaccattatcacccttgttcctccaacaaccgtcagccctattacaagagttacctttggtccatttggtggcacaaaacatcagggcacaacaactacaacaacttgtgctagcaaaccttgctgcatactctcagcaacatcagtttcttccattcaaccaactggctgcattgaactctgctgcttatttgcaacaacaactaccattcagccagctagctgctgcctacccccagcaatttcttccattcaaccaactagcagcattgaactctgctgcttatttacagcagcaacaactactaccattcagccagctagctgatgtgagccctgctgccttcttgacacaacaacagttgttgccgttctacctacacgctatgcctaacgctggcaccctcttacaactgcaacaattgctgccattcaaccaacttgctttgacaaacccagcagtgttctaccaacaacccatcattggtggtgccctcttttagattgcttatgagttatagttcaataatgaagttttttggatgatgtttgtggcttcccagaaataagaaagtacatttct

SEQ ID NO: 8329 - DNA, 968 bp, Gossypium hirsutum
ggaagacatatggggtgaccatatgcaccatggatattacgacccgggttccgatgtttcgggttcagatcatcgtgccgctcagattcgaatgatcgaagaatcgctccgtttcgctggaatatcggatgacccagcaaacagacccaagagaatagttgatgttgggtgtgggataggaggcagttctaggtatctagcaaggaaatatggagcaaaatgccaaggcattactttgagccctgttcaagctggaagagccaatgctcttgctaatgctcaagtactagcagaccaggtttgttttgaagttgcagatgccttgaaccaaccattccctgatgaccaatttgatcttgtttggtctatggaaagcggagaacacatgcctgacaaacccaagtttgttgaagagctggtgcgagtggcagctccaggaggcacaataatagtagtgacatggtgccatagggatcttggtccatctgaagagtctttgcagccatgggagcaaaagcttttaaacagaatatgtgatgcttactatttaccagagtggtgttctacttctgattatgtcaaattatttcagtccctatctctccaggatataaaggcaggagattggactgagaatgtagcacccttttggccagcagtaatacgttcagcattgacatggaagggcttcacatcgctgctacgaagtggattaaaaaccataaaaggtgcactggtgatgccattgatgatcgaaggtttccagaaaggggtgataaagttcgccatcattgcttgccggaagccagctgagtaggccataacccaaatcttaatttctactgtaattcatccgctcaaatctgtgtcaatggtgaagctcctatatgacattgctttaaacatcccttatggtgtaagggaaaatgagcaaataaagttgaatacaaaactgatgccactgcaat

SEQ ID NO: 8330 - DNA, 1403 bp, Zea mays
ctgcactgcacggtagtcgcgtcgagtcgacgcgcgattcctgccatttgggtgggccagcctttcctggcaatctcggggggcgtttcgcctcgctgcgtggcagaaaggtgtgacgtgtgatgcatcccaaggctcgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaggctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgaaacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcggcctcggcatgttccaacaggactcaggtcccagcctgcaacatgaagctcaagtacgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaagacgctgatgaagagacgcacttaccttctggagatgaatggcttctaggaatcttgtccatcttggtatcgagcttgttggtgctatgcatggtacatttagctgagtgtctcatctgtgtaatattcaagaaggcaccatctctagttgatgcttgctgtctgctgttttagctctttgtacagtgttaacatttggttatataaagatcatatcaagtcctctagtgtaatagtgaatcttatctctctacagttcaccttc

SEQ ID NO: 8331 - DNA, 1689 bp, Zea mays
cctgcttccacctgcatctctctcctcggtcctcgctcgctcggcttccctctctccgccgagaccgagaggaggcatccctgacgtacggacggcggccatggggacgcaggcgccggagaactaccccgccgagaaggtacaggacgcgaggagcgcgcgggagaaggccatcgacgactggctcccgatcacctcgtcgcggaacgccaagtggtggtactccgccttccacaatgtcaccgccatggtcggcgccggcgtgctcagcctgccctacgccatgtccgagcttggctggggccctggcatcgcggtgctggtggtgtcgtgggtgatcacgctgtacacgctgtggcagatggtggagatgcacgagatggtgccggggaagcggttcgaccgttaccacgagctggggcagcacgcgttcggggaccggctgggcctgtggatcgtggtgccgcagcagctggtcgtcgaggtgggcgtgaacatcgtgtacatggtgaccggcggcaagtccctgaagaagttccacgacgtgctggtgtgcggcgacacgggggtgtgcgaggggaaggacaacatcaagaccacctacttcatcatgatcttcgcgtccgtccacttcgtcctctcgcagctccccaacttcaactccatctccggcgtctccctcgccgccgccgtcatgtcgctcagctactccaccatcgcgtggggcgcgtcggtgcacaaggggaggatgtcgggcgtggactaccacctgcgcgcgacgactacgccggggaaggtgttcggcttcttcggcgcgctgggggacgtggcgttcgcctacgccgggcacaacgtggtgctggagatccaggccaccatcccgtccacccccgacaagccgtccaagaagcccatgtggaagggcgtggtggtcgcctacgtcgtggtggcgctctgctacttccccgtcgcgctcatcggctactgggcgttcggaagcacggtcgaggacaacatcctcatcacgctcagcaagcccaagtggctcatcgcgctcgccaacatgatggtcgtcgtccatgtcatcggcagctaccagatctatgccatgccggtgtttgacatgatagagaccgtgctggtgaagaagctgcgcttccctcccggcctcacgctgcgtctgatcgctcggactctctatgttgcgttcaccatgttcatagccatcaccttccccttcttcggtgggctgctcggtttcttcggcgggttcgccttcgcgccgaccacctatttccttccctgcgtcatgtggctcgcaatctacaagcccaaaggttcagcctctcctggttgaccaactggatgtgcatcattcttggggtgctcctgatgattctgtcgcccatcggagggctccggcaaataataatggaagcgaaaacctaccagttctactcgtgagctctaccaccagccatgacttgtgactgcacgattggagaaatctgtcaaagcctcaaccacgagtttttttttgtcatgccaaacacatacatatacgtactgtttcttaatattcaaaggtgttcttcgtggcttgcgtgtgtacagtattatgtgtatgagggagacttttaagtttaatgatgctggctgtcaaagataatggcggttcaattacacttt

SEQ ID NO: 8332 - DNA, 1619 bp, Zea mays
gtcgacccacgcgtccggacgtctcgccctcggcttcttcctcccctccctgaccgctgccgcgacctctcggcgaaaccctaacctaccttagaccccgccgccgccgccgccgccgcccaagggagagagagacttgcacatcaaagggcgtccgatggggaagaagaagaagcgcgtcgataaggtcttctgctactactgcgaccgcgagttcgacgacgagaagatcctcgtccagcaccagaaggccaagcacttcaagtgccacgtatgccacaagaagctctccaccgcctctggcatggccatacacgtcctccaggtccacaaggagtccgtgaccaaggttcctaatgcaaagcctgatagggagtcaacggagatagagatatttggaatgcagggaattcctgcgcatgtattggctgctcattatggagaagaggaagacccttcaacaaaggtacccaaagtagaagtgcctcaggtaaggcctgttattatgcctaattcgctaggcatggcatttcctccgcgaccagcttatggtgtggcacctccaatctataatcctgcactcaatcctttgatggcccggcctccaatttggcctgctgcaccagcgcaagcttggtattcgcaacaagcagcatatccacaacaatcagctgtttcagttcctcccatagttgctgggctcccaccacaacagccactattcccaattcagaatgtgcctactcctatgacatcagcagctgctaatgtacttcaaacatcgtttcctatggcccctccaggagtaccttcacctgttgcccctcatgtttcccagcctttgtttcctgttaacacttcagctgtcaatggagctgtaaattccccatttttagcatctgttgcacctggaaccattccagcaagctcttcagcagcagtcggtgttgcaggaattggatatggaaccaataaccaaggcactagagatccagcagttggatcttcacctgcagtatccaataataaggcgtctggtgcccaaccagctacgaatgaggtatatctggtgtgggatgatgaagcaatgtcaatggaggaaagaaggttgtcgctgccaaagtatcaggtgcatgatgaaactagccagatgaactctgttgacgcagcaattgatcgaagaatatcagaaagtcggctggcaggacgcatggccctatgaagaagctgggctttgctcggtagattatcccccttgcatttcaccgaaggactctgcctgcgcttgtatctcgctgtgcagcagtctgccctcttcatttagttagcgaatggagttgctgcagttaagaggaatgtgttgtttctgacttgtttgagtgtcgagcctttgttcttctatgtttccagcatcgacaagaaaatgaattagtagcacttaggagttattttggtccaactgtcgcctcattgggaatatattgatgaacacctcaatccctgcccgattgtaacctggtcatgtgctattgccaattgaagcctaatgctgtgcattggcttgaaagcaacttaaaaatgttacggattataaaaaaaaaaaaaaaaagggcggccgc

SEQ ID NO: 8333 - DNA, 1672 bp, Zea mays
gccagagtcctcacggatggcctcgccagcgatggtcccgctgcggcagctcttcgtcgacggcgagtggcgcccgcccgcgcagggccgccgcctccccgtcgtcaaccccaccaccgaggctcacatcggcgagatccctgcgggcacagcggaggacgtggacgccgcggtggcggcggcgcgggcggcgctcaagaggaaccgtggccgcgactgggcgcgcgccccgggggccgtccgggccaagtacctccgcgctatcgccgccaaggtgattgagaggaaacctgagctggctaagctagaggcacttgattgtgggaagccttatgatgaagcagcatgggacatggatgatgttgctgggtgctttgagtactttgcggatcaggcagaagccttggataaaaggcaaaattccccagtttctcttccaatggaaacttttaaatgtcatctccgaagagagcctattggggtagttgggctgataactccttggaactatcctctactgatggctacatggaagatagcccctgcattggctgctggttgtacagctgtgctgaagccatctgaactggcttctgtgacttgcttagagcttgctgatatctgtaaagaagtcggtctcccttctggtgtcttgaacattgtgacaggattaggtcctgatgctggcgctcctttgtcagcacacccagatgttgacaaggtcgcttttactgggagttttgaaactggcaagaaaattatggcatcggcagctcctatggtcaagcctgttacactggaacttggtggaaaaagtcctatagtagtatttgatgatgttgacattgacaaagctgtcgagtggactctgtttgggtgcttttggaccaatggtcagatttgcagcgcgacatctcgtcttcttatccatacaaaaattgctaaaaaatttaatgagaggatggttgcatgggccaaaaatattaaggtttcggatccacttgaagagggttgcaggcttgggccagttgttagtgaaggacagtatgagaagattaagaagttcatatcgaatgccaaaagccaaggtgctactattctgactggaggtgttagacctgcgcatcttgagaaggggttctttattgaaccaactattattactgatatcaccacatcaatggaaatctggagggaggaagtctttggtccagtcctgtgcgttaaagaatttagcactgaagatgaagccatcgaacttgccaacgatacacagtatggtttggctggtgctgtaatttctggtgatcgggagcgctgccagaggttatctgaggagattgacgctggatgcatctgggtaaactgctcgcaaccctgcttctgccaagctccctggggcgggaacaagcgcagtggatttggacgtgagcttggagaagggggcattgataactacctgagcgtcaagcaagtcacggagtacatctctgatgagccgtggggatggtaccaatccccctccaagctgtaaactggcaagacgaaaatttgtctgtttcggtagaataaatatatctcgatgctatacagaacgaacccgtgtatcacattgaatgacatggtgaaaaaggcacatctgcaggataaaggcgagagttgagttgaaacc

SEQ ID NO: 8334 - DNA, 929 bp, Zea mays
gggaaccctagcctcctcgtcgttgaatccaccacaccacaccatgagcgggagcgcctccaggaagctcttccagaccgccaggtccatcgtcctctccgcttctcaacgctcctccttctccgtcctcgccgccgagggccgcaccgccgcgctcgccaactttggcaggaagatcctccccagcgcctgctcctaccacaggcagggatcccacgccgcgtcgggatggggagccatcgctgccgcagtccccgccgcagtttacatgctccaggaccaggaggctcatgctgcagagatggagcgcactttcattgccatcaagcccgacggcgtccaaagaggcctgatttctgagattgtgaaccgattcgagagaaaaggctacaagcttgttgccatcaagctgattgtcccatccaaaggattcgctgagaagcactaccatgatctcaaggaaaggcctttcttcaacgggttgtgtgacttcctcagctctggccctgtacttgcaatggtttgggaaggagagggtgtcatcaagtatgggagaaaactaattggtgccacagacccacagaaatctgaaccaggaaccatcaggggcgatcttggcgttgttgtgggaagaaacatcattcatggaagtgatggcccggagacagcaaaggatgagatcgccttgtggtttgaacccaaggagctggtctcttataccagcaatgcggagaagtgggtctatggggtgaattaaccagcgactaaatctcttgaggtttgcttttttcttttcagttttcacataattgccgacagaccaaggcaggatgtaataaagtagctaccgtcacctattacttttgagttggattgattgtggtgcagtaaggcacaaggaaaggaaggaatacaccgtgaaatttgtt

SEQ ID NO: 8335 - DNA, 1752 bp, Zea mays
agtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgcctggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccctccgagcccacccacaccaaggtgaagcagctgctcttctccctcctgctctcccgcaaggacgacgtgatccccaccttccgctccaacttctcctcgctcctcgccaccgtggaggcggagctggccaagggcggcaaggccgagttcaacaagctcaacgacgtcacctccttcgacttcatcggcgaggcctacttcggcgtgcgcccctcggcgaccgacctcggcaagggcgggccgaccaaggcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaataagacttctctctcaccctcggccccaccttcacgtgtgattggaggtgtttgtcgcttttgtaataattataatgcaggatggcatgttgcataaattgctcccc

SEQ ID NO: 8336 - DNA, 854 bp, Zea mays
cacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagggacagtttcctgtacttgtggggtgaatttgtacgtgtgatacggtaacttggtccgtgtactgtttatgctgctacgttttccttcctaaaagtacgtatatatatacagcacttgcgagtggctttacttg

SEQ ID NO: 8337 - DNA, 1323 bp, Zea mays
ccgcacaaactcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcacctaccgctccaagatcgagaccgagctcgcccgcatctgcgacggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggtgacgagatcaaggatgctgctgccccgaaagaatctgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgcaaagctatttgccttgaaa

SEQ ID NO: 8338 - DNA, 2006 bp, Zea mays
cgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatgagtaagacgggtttctggtgtcgatttgcttctgagtttttttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatg

SEQ ID NO: 8339 - DNA, 1003 bp, Zea mays
agttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggagaagacgggtcaagtgatgggggcgacgcaggagaaagggagggaggccaagcacaaggcgtccgacgcctccgaccgcgccatgggaatgggccacgacgccatggaggcgaccagggagaaggcgcgcgccgccgcggaccgaaccatggggatgggccacgacgccggggaggcggccaaggacagggcgtaccgggccaaggacgcggcctccggtgccgctggccgcgccagggacactgcgtccgacgcggccggcgctgccggggaccgcgcccgcgacggcgcgcagcagaccgggagctacgtcgcgcagacggccgaggccgccaggcagaaggcggccggcgccgcgctgtacgccaaggacaccgtggtggccggcaaggacaagaccggcgccctcctgcagcaggcaggggagaaggtgatgagcacggccgtgggggccaaggacacggttgtcagcacggccgtgggggccaaggacacggttgtcagcaccgccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttctcatttcatttcaaactttcagtgtttggtgcatgctgtaaactctcttcaggacgggtcgtttgacatttgtgtcgactgaagcctccgcgctttcgactcaacgatgtatatgtaataataaagtcgcaaagctgttgttttattttc

SEQ ID NO: 8340 - DNA, 2701 bp, Zea mays
cgcgtcgcctcctcccttcccccaccccgccgccgccctcgcgtccgtccgtccgtgcctagttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgcgctgttcactgcactctttagcactgtgtccttcttgcttggcgccatcacctctctggtctctggtttccttggcatgaagattgccacatatgcgaatgccagaactaccctggaagctaggaagggtgttggcaaggcttttatcactgctttccgctctggcgctgttatgggtttcctgcttgcatcaagtgggcttgtggttctgtacatcacaattaatgtatttaagttgtattacggtgatgactgggagggtctttttgagtccatcactggctatggtcttggtgggtcgtccatggctctcttcggaagagttggtggaggtatctacacaaaggctgctgatgttggtgccgatcttgttggaaaggtcgagaggaacattcctgaggatgatcctaggaacccagctgtgattgctgataatgttggtgacaatgttggtgacattgctggaatgggatctgatctctttgggtcatacgcagagtcttcttgtgctgcccttgttgttgcgtctatttcatctttcggaatcgaccatgatttcactgggatgtgctacccactccttgttagctctgttggtatcattgtctgcttgatcaccaccctttttgctactgatttctttgaagtcaaggctgtgaaagaaattgagcctgcacttaagaagcagctcatcatctccaccgtcctgatgacttttggtattgctctaatcagctggttggcccttccagctaagttcaccatctacaacttcggtactcagaaggaggtttccaactggggtttgttcttctgtgtttcaattggtctgtgggctggtttgattattggttttgtcacagaatactacactagcaatgcatacagtcctgtgcaagatgttgcggattcgtgcagaactggtgctgccactaatgtcatttttggtcttgctcttggatacaagtcggttatcatcccgattttcgctattgctgttagcatctatgtcagtttctccattgctgcgatgtacggcattgcagttgccgctcttggtatgctgagcacaatcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgtcctctcccccaaggttttcattggtttgattgttggagccatgcttccgtactggttctctgccatgaccatgaagagtgttggaagcgccgccctgaagatggtggaggaggtccgcaggcagttcaacaccattcctgggttgatggagggaacagccaagcccgactacgcaacctgtgtgaagatctccactgatgcttccatcaaggagatgattcctccgggcgctctggtcatgctgactcccctcatcgttggaaccctcttcggcgtcgagactctctccggcgttcttgctggtgcccttgtttctggagtgcagatcgccatctctgcttccaacaccggcggtgcatgggacaacgccaagaagtacatcgaggctggtgccagcgagcacgcgaggacccttggccccaaggggtctgactgccacaaggccgctgtgatcggtgacaccatcggtgaccccctgaaggacacctccggcccgtccctcaacatcctcatcaagctcatggccgtggagtccctcgtgtttgcccccttctttgccacccagggtggcctgctcttcaagtacctgtaaaagggacaacaccaagcacacagcagaagtatacgatctcccgaccgaccgtggacaatatcgaataactcctgccaaatcgccagttcttttgtgtactgtgcgctagccgccgcctagctgcactgctgtattttttgtttcaggattgctgctgctgttcgcacattcaatctttggggcctcccggagccgccggaggcgcgttttactgttagccttactactcttactccctgtagctccacgtagaagagaaccgatgtcctgcgtctggcaatttttcttagtccctcgatgatggcgatgatgctgaaacctttttttg

SEQ ID NO: 8341 - DNA, 1174 bp, Zea mays
caccagaccaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcctgggctgaccactggatcttctgggtcggccccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcaaaattatgagacagcgagtcaagctttaagagttc

SEQ ID NO: 8342 - DNA, 1138 bp, Zea mays
cgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacatgcctagaagctagtacctagtgtttgctgctgtctaatgacattatgcaatgtgatctggaccctggtttcttgggtgcgacgcttgtagcagccgtcttatgattatttgtcgggaaaatttgggggctccccatatgagatgctgccgggcaagacctcgccatcccccacctcgtttcaggcgggggacgctggagcctggtccggttgggttgggaagccccttaaactgttgtcgcttgcattttaaccttttcatcgccgttcagtggtcct

SEQ ID NO: 8343 - DNA, 2025 bp, Zea mays
cgctttgttaacaaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgcgaagaagttccagtctgctgcttactccaactgcgcaaagaagccatcctgatatcccttttggcttcctcgttctagtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaggatggagtgcttgatgagtaagacgggtttctggtgtcgatttgcttctgagtttttttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataagggttgttttcgtg

SEQ ID NO: 8344 - DNA, 1866 bp, Zea mays
tcgcattccagatctcccctgcctccgctgtataaatagaccctcaagctccctgcaacatccatcaaggcccaagctcagcgaccaccaagcagagcaagccagtgaggtctctcagagcgtagccagccagctacaatggcggggaacgcgctagccaactatgtccaggtctacgtcatgctcccgctggatgtcatcactgtcgacaacacgttcgagaaggaggacgagacgagggcgcagctgaagaagctgacggaggcgggcgccgacggggtcatgatcgacgtctggtgggggctggtggaagggaaggagccgggagtctacgactggagcgcctacaggcaggtgttcaagctggtgcaggaggccgggctgaagctgcaggccatcatgtcgtgccaccagtgcggcggcaacgtcggcgacgtcgtcaacatcccgatcccgcagtgggtgcgggacgtcggcaaaagcaaccccgacatcttctacaccaaccggagtggggtgacgaacatcgagtatctcacgcttggagtggacgaccagcctctcttccatgggagaactgccattcagctgtatgctgattacatgaagagcttcagggagaacatggcagacttcttggatgctggtgtcgttgtggacattgaggtgggacttggccctgctggcgagatgaggtacccatcgtatccccagagtcagggatgggtgttcccaggcgttggagaattcatatgctatgataagtacctgcaagcagacttcaaagcagcagcagaagaggctgggcatcctgagtgggatttgcctgatgatgctgggacgtacaatgacactcctgagaagacccagttctttgcggataacggaacataccagaccgacaaggggaagttcttcctcacatggtactcaaacaaactgatcaagcacggtgataagatcttggacgaagcaaacaaggtcttcttgggatgcaaggtgcagctggcaatcaaagtctctggcatacactggtggtacaacgttccaaaccatgcagctgagctcactgccggatactacaacctagatgacagagatggctacagaaccatagcacacatgctcacaaggcatcgtgctagcatgaacttcacttgtgctgagatgagggacagtgaacagagttcagaggcgaaaagtgcacctgaggaactggttcaacaggtgttgagtgccggatggagagagggcctaaatttggcatgtgaaaatgcactcaaccgatatgatgcaacagcttacaacaccatcctcaggaatgcaagacctcaaggcatcaacaagaatggccctccagaacacaagttgcacggattcacctacctccgagtatctgatgaactgttccaggaacagaactacaccactttcaaaacttttgtcaggagaatgcatgctaacctggattataatccaaatgtcgatccagttgcaccattggaaagatcaaaggcagagataccaattgaagaaatcctagaagtagcacagccaaaattggagccatttcccttcgacaaggacaccgacctaccagtttaaacactccaatgatgcaatctacaggaagaatcacaagacacttcaaaaatcaagacaaatagtaagcctattgtcgagcagtagtctattaactaaataaaatgctgtgtggagcatattataatcgcatattgccccaataatattgtgttgttaaacctgaggcttggtgattatctgatgagttgtaataatagccttggtcttcctgttgtatgtatgtatttgagctaaggaataaaaattgtggctttgtgggtt

SEQ ID NO: 8345 - DNA, 687 bp, Glycine max
gtcgggaaaaggggcaaagggattgataacaggtaaaacctcagcttcagccaaagacaaagacaaagacaagaagaaacccgtttctcgttcttctagagctggtcttcagtttcctgttggacgaattcaccgtcttttgaagtcaagggtgagtgccaatggaagagttggggccacagctgctgtgtattctgctgctatactggagtatctaactgcagaggtgttggagttggctggtaatgcaagcaaggatctgaaggtgaagcgtattacccctagacatttacagcttgctatacgtggagatgaagaacttgacaccctcattaaaggaacaattgccggtggtggtgttattcctcatatccacaagtctctaatcaacaaatcctcaaaggagtgagggttaaaagaaaaatatttgaattaaccttggagatgagttttcctgtaaatttgatggtatcttattttgtggatattttgcttgttgtgttagtttggtagaagagacatcctgcagcagttctgatatctttatttgagctgtatggactgacatactggcttctgtgctctgttgctgcaagctagctacatgaaactagctgttaggatgtatattgaagcatggttaattattatgttcaacctattaatctatgatgtttcaatgttttg

SEQ ID NO: 8346 - DNA, 1212 bp, Glycine max
gcaattaataaagttagggggggtgcggttcaggaaggagcgaaagggaaatcagaaaatggcacagtcctcctcgatcgtcgttactctgaggcagcacttgtttaaaaggaacctcacctctctcactctgcctcactctccttctcttccttccttctccttctctctgagaacaacaccccacactcctctctctctctccgcttccttctcttctcacacctccatggcccacacttcccttccctccgccgatgccggcatggacgctgtccagcgccgtctcatgttcgaagacgaatgcattttggtggatgagaatgaccgtgtggttggtcatgattcaaaatacaattgtcacttgatggaaaagattgaagctgagaatttgctgcatagagctttcagtgtattcctgttcaactcaaagtatgagttgcttcttcagcaacgatctgcaacaaaggtaactttccctcttgtgtggacaaacacctgttgtagccatcctctgtaccgtgaatctgagcttattgatgagaatgcccttggagtaagaaacgcagctcagaggaagcttttggatgagcttggtattgttgccgaagatgtaccagttgataagttcacccccttgggtcgcattctttacaaggcaccttctgatggcaaatggggagagcatgaactggactatctgcttttcattgtccgggatgttaatgtgaaccccaatcctgatgaagtggctgatatcaaatatgtgaaccgtgatcagttgaaggagctgttgaggaaagctgatgcaggtgaggaaggtctgaagctatcaccttggttcagactagttgtggacaatttcttattcaaatggtgggaccatcttgagcaaggaactcttggggaggccactgacatgaagaccattcacaagttgacataagtaagttcagaggagcttcctgcatccctgtaatgaagggtggctgcattccgaccaaattagaacgaaattggacctattttgagaagaattttcggagcagtgacttataggatgttgttggtctttttgttattcgatgatagctagaacaataaacgtctgagtgtttaaattagaagaattttttgttgttgcaaatttcggattttgggatgcaggcaagtttatcggaataagaatacaagatgttagtgatttgaatc

SEQ ID NO: 8347 - DNA, 1547 bp, Glycine max
ccgaaattctgatctgtgagaatgggaaaaggtggatctctgagcgacggcgtggtgaagaagatcgttctctcctacagctacgtggcaatatggatcttcctgagcttcaccgtcatcgtctacaacaagtacatcctggacaagaagatgtacaactggcccttccccatctccctcaccatgatccacatgtccttctgcgccaccctggccctcctcctcgtccgcgtcttccgcctcgtcgagcccgtctccatgtcccgcgacgtctacctctcctccgtcgtccccatcggcgccctctactccctctccctctggctctccaactccgcctacatctacctctccgtctccttcatccagatgctcaaggccctcatgcctgtcgctgtttactccatcggcgtcatgctccgaaaagaatcctacaaaaacgacaccatgcttaatatgctctccatctccctcggcgtcggcgtcgccgcctacggcgaggcccgcttcgacgcctggggcgtcctcctccagctcggcgccgtcgccttcgaggccacccgcctcgtcatgatccaaatcctcctcacctccaaggggatctcgcttaacccaatcacttctctctactacgtcgcgccgtgctgcctcgtgtttctctctattccgtggatctttgttgagtatcctgttttgagagacacttccagcttccacttcgatttcgtcatcttcgggaccaactccttctgtgcattcgcgctgaatctggccgtgtttcttcttgttgggaagacgtctgcgttgaccatgaatgtggccggtgttgtgaaggattggttgctgattgcgttttcgtggtcggttattaaggacaccgtgacgccgataaatttgttcggctacgggcttgcgttcctcggcgtggcgtattacaatcactcgaagctgcaggcgctcaaggccaaggaggcgcagaagaagaccgcgcaggcagatgaggaggaagggaggttgctcgaggacagagatgacaacaagaggaacgaacagcagacttaacttttatttatttttaatcgttccctgttttattttacacagattcaagaaaggaaaaaaacaaacaagaggtttggtttggttttcgaggcaaatatggaaatgtcatcgtcctctctgggcatattgccggttcggtattgtttttttagttgctagatcttcttcacgttgccaatgcggtgggtagttaattagtagatatgggtttgagatttgagaacaattatgtgttactagagctagagtctccaatccttttattattattattattattattttcttttatctcattcccgttttcggtggttttgttttatgttatgttattgtaggaactcgatttatggagtttacatgcttcttattaattcatagtacatttcaattctgtgtaatgtgaatttgggatttatcttatagccaagctgtctgacaaatttcacttggcactgtgttccgaattactctgtttcggttgt

SEQ ID NO: 8348 - DNA, 1082 bp, Glycine max
tctctctatctctcacacacactttctctctctctctctctcacccagatcttgtagcaatggcgagcgctcccactccacgcgaagagttcgtgtacatggcgaagctggcggagcaggccgagcgctacgaggagatggtggagttcatggagaaggtctccgcctccgccgagagcgaggagctgaccgtggaggagcgtaacctcctctccgtcgcctacaagaacgtgatcggcgctcgccgcgcctcctggcgcatcatctcctcaatcgagcagaaggaggagagccgcggcaacgaggaccacgtcgccgtcatccgcgactaccgctccaagatcgaggccgagctctccaacatctgcgacggaatcctcaaactcctcgacacgcgcctcgtcccctccgccgcctccggcgactccaaggtcttctacctcaagatgaagggagactaccacaggtacctcgccgagttcaagaccggcgctgaccgcaaggaggccgccgagagcacgctctccgcctacaaagccgctcaggacattgctaataccgagttgcctccaactcaccctatcaggctgggtcttgctctgaacttctccgtgttttactatgagattcttaactctcctgatcgggcttgcagccttgcaaaacaggcttttgatgaggctattgctgaattggatacattgggagaggagtcatacaaggatagcactttgatcatgcaactgctacgtgataacctcaccctctggacctctgacatgcaggacgatggtgcagatgaaattaaagaagccgcacccaaaggtgacggggaacaaaattaaacataccatactctctgcttattagtcattgaacttcccttctgtaatgttttcaaagggagaaggtgttgaatgctaatctcaatgttactgagattttgggcattcgtgttcttcgttatgaattgtggatgtactgggctattttagtttgtccttccatttatacgcgtttctgaactgcctattttcttaatgacactgaaatttccattatgatgctgtttagaataaaaa

SEQ ID NO: 8349 - DNA, 519 bp, Gossypium hirsutum
aacattgtttgcacttgttattgccataaccaaggatcttccagatgtagaaggagatcgcaaatttcaaatatcaacattagcaacaaagcttggagttagaaatattgcatttcttggttccggacttctactggtgaattatgttgctgctgtgttggctgcaatatacatgcctcaggctttcaggcgtagtttaatgatacctgctcatatctttttggcggtctgcttgatttttcagacatgggtgttggaacaagcaaattacaaaaaggaagcaatctcggggttctatcgtttcatatggaatctcttctatgcagagtatgcgattttccccttcgtgtagaatcctaatctccaccctccatactttttgttttgcaaatttttattttcattgagggagagtagttacgtgagtatctatatgaattcccatctaatattcattgcatcttttaataacgctatcttgaattagttcttatgcaaataaataaataaattcaatag

SEQ ID NO: 8350 - DNA, 783 bp, Zea mays
ctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttgaattgc

SEQ ID NO: 8351 - DNA, 807 bp, Zea mays
gcaagcacacaactagggcgaccgccgccgacctacggccagctgtgcccatgtcttcgtcgggccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctggctgcttcggtgaagggagtagggttgatgtaacaagttaccgttgacgtgacagagtaggcttatcatcgacgtagttggggtcttacttgctgagcatctgcgacggcttgagacttttaggcatgtcttctatctccgaagcactctttcggtctttcctgatcagtgagctagcgctctgaaaacgtagcgatgagctgtcccattttcgactaactatttagtgccagtgaatggcctaattctacaact

SEQ ID NO: 8352 - DNA, 818 bp, Zea mays
tctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttgaattgcatgcattgcatgaggtttcttgttggtt

SEQ ID NO: 8353 - DNA, 832 bp, Zea mays
ggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8354 - DNA, 961 bp, Zea mays
caaaagtcgcgtgctgtgctctgctctcgcctcgcacggactcgtggtaaaggatggagaccatgtcggctctcgcgaggacggcgccgccccttgctgggaccattcgccggccgtcctgcgcgctgcggccgacggcgtccctctccttcgccgccgcttcaacgacgccccgcggccggctcgggctggggctgagcacggcgccggcggggagcgggagggcggccagggctcgcgccgtcccgcagcgcatcgtcgcctcctcggaggttgagcgaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggccctgttgtctgcatggcctgggagggtgctggtgttgttgcatcagctcgcaaattaataggagctactaacccccttcaagctgaaccagggactataaggggtgatcttgcagttcaaactggaaggaacgttgtccatggaagtgatagtcctgataatggcaagcgtgaaattgaactgtggttcaaagaaggcgagctctgccaatgggaatcagttcaagcaccgtggcttatagaataactcttgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagctaatttcttgtcatatttacatgtaataaagtccctctactacagt

SEQ ID NO: 8355 - DNA, 882 bp, Zea mays
cgtcacccctgacgctcgacgcctctcctcctctcctcccccacccgtccatcgccccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcagaaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaatgtaccgtggttgtgaaccggtcaatgtgatctgaaataaaacattgcgtgccaagtttgtgttacaagtttgatgcactgggaatgccaagcaactaatgtggtaataaacatttcgtc

SEQ ID NO: 8356 - DNA, 1085 bp, Zea mays
acagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttac

SEQ ID NO: 8357 - DNA, 1563 bp, Zea mays
cttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacatatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttt

SEQ ID NO: 8358 - DNA, 820 bp, Zea mays
gatacgtttcacccttcctctccccactccgaaccctagccaccgtgctcacttcccagctcgaacccgccgcgggcgagtccacggcagtgcaggacctgatcctgcggtctaggccgcggcggtgagatggtgatggtgtcaggcggcggagggaacgcgtgggcgaaggagatgaccctccgccgcaggatagccagcatattcaacaagacgcaggaacacttccctactctgaaggactacaacgattatctggaagaagttgaggacatgactttcaacctgatcgaagggatagatgtcgaggagattgaagcgaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgtttttgggggagtggctcagcctcgccccacaggtatggcgccccaactaatcggcagtgggtcggatcctctgcaaggagacgacgaggagaccaggagactacgcgcagagcgagcagcacgggctggcggatggactgctgaattgagcaagagaagagcgcttgaggaggcgtttagcgccatattcatctaggattagatcaaaaagcaacacatggcctggaggaaagccggcatacttaaaatggctgtcaaactacaaagcgttggatgatctgtgccgtaattatctttgggac

SEQ ID NO: 8359 - DNA, 787 bp, Zea mays
caaaaaacccaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgggcggcggcgggcccacgcgcacctacgtccgcgacgcgcgcgccatggcggtcaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctctgaagatgtgggagcagtgccagcgagttgtgaggacctctacctgtgtggaatgtggcgaggaataatcgtagtctgtagtgggggtgcttctggtgtgcgtgtttgcttccttcggtcgcggtgtctgtctaccaattcctatctgatgtatgggcttcggtttcgtatgaaccatgccggatgctttcagtatgttc

SEQ ID NO: 8360 - DNA, 898 bp, Zea mays
cagacaccgaacattgtggaggagctcaaacttgcaagggacatttatgagcatgctgttgttttgagtgtgaaacttgaggaccaagatgcgtttgaacgcgatttctgccagctgaagccttattacatggatacatgtggcataattcccgcctcgccagaggagtacccaattttgggactcaatcttctgaggctgttggttcagaatagaattgccgaattccacactgagctggagcttttacctgtcaaggcactcgagcatccttgcatcaagcatgctgtagagcttgagcaatccttcatggagggtgcctacaaccgagtgttaagcgctcggcaggctgtgccacatgagacctacgtttacttcatcgaccttctcgccaaaacagttagagatgagatcgctgggtgcagcgaaaaggggtatgattctctatctgtgagtgatgcaaagcaaatgcttatgttcagttctgaccaagatctgcacgagtacatcactgaggagcacccggaatgggagattaagaacggtgctgtcttcttccagaaggcgaaggagtcacagccctgcaaggagatcccatccttgcagcttatcaaccagacgctcagctacgccagggagctggagcgtattgtatgatttaaaccaatccctggtggttcttttttcccctgtggccgcttggcatggcttgtactgtcctttgcatttgggatcatctttgatcgcagctctcatctgactgaaacatcatgtgaatctctgaagggctcagtttctccggcattggtctgttaacttcatttgtatttcaccacattaactgcattgcttgaaaaatgcccggcattcactgctgctgtgaacttttgatgggctt

SEQ ID NO: 8361 - DNA, 817 bp, Zea mays
ggcgaagatcgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcggcggcggcggcctccgagaccgccgccttcgccagcgcccgcatcgactggaaggagacgcccgaggcgcacgtgttcaaggccgacctccccggcgtgaagaaggaggaggtgaaggtggaggtggaggacggcaacgtgctgctcatcagcgggcagcgcagcagggagaaggaggacaagggcgacaagtggcaccgcgtggagcgcagcagcggccagttcgtgcggcgcttccgcctccccgagaacgccaagaccgaggaggtgagggccgcgctggagaacggcgtgctcacggtcaccgtgcccaaggccgaggtcaagaagcctgaggttaagagcatccagatctccggctgaagaagacatggacgcgaggtgaatggtcgcgtcgcgttcgcgtcgcggcgtcgggtcttgggtttcagcgacgcgactcgtgtgtgtggtactgtggttgctctgctttggtatgtctggtgtgtacgtgtgctgttcagtgtttcgtggtcatcgtctgtacattgtgctgttcggtgagctccccgactcagtgtgttgtgttctgcgagtgaataaataaaaacaaacc

SEQ ID NO: 8362 - DNA, 1149 bp, Zea mays
cccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatatt

SEQ ID NO: 8363 - DNA, 1090 bp, Zea mays
cgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgc

SEQ ID NO: 8364 - DNA, 1162 bp, Zea mays
gtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagtcgaacaaagtttttttt

SEQ ID NO: 8365 - DNA, 1035 bp, Zea mays
ggagaaggaccctctctgtcctcgcggggggcggcaggaggagcagatgttcccgcctggcctgatccaccaccgccctgacgccaccgctcccggcgatgggccaccgcgctccggccccggtgggccgagccttgtactgacggcggaccccaagcccaggctacggtggacggccgacctccacgagcgtttcgtcgacgccgtggcccagctcggcggacccgagaaagcaacaccaaaaactatcttaaggacgatgggtgtcaagggtcttactcttttccacttgaagagtcatcttcagaaatataggttaggtaaacaatctggtaaagaggggtcagagcaatctaaagatgcttcctatcttctagatgctcaaagtggaatgagtgtgtcccctagagttgctgcccaggatatgaaagaaagccaagaagttaaagaagctctgagagcgcagatggaagtgcaacgaaggctgcatgaacaagtggaggtccaaaagcgcgtgcagatcagaatggaagcacttgagaagtacatcgacagtatcctagagagcgcatgcaagatggttactgaacaatttgcttcgagtggcttcagtatctccaaccctgatctcccggagatatcccctggaggggtcatgtgtggctccacggacacgttgggctcgtcggtgttgaaccagctttctgtgagctccatcgactcgcacagtccaggaggcaaaccttctccatcaggcatggaaggtccgacactgctccagaaatcgcctgagctcaagcggaggtcctcttgaactgtgacatcgaattctgaggttggtgatgatggctgtctctgtggagtgtctgaatatggtggtgacaagggaaatggtggcccagtcttgtggtagctgactctctctccaggtagcaggacgtgctgtgtttgttgatcaatccaagtatcaaacggacctactatgttcatgtgaacttcctcaagtgctagttaaaaagttttcatgcttctgtc

SEQ ID NO: 8366 - DNA, 1239 bp, Zea mays
ctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttattaaatttgcttgtttggttttaccttgtg

SEQ ID NO: 8367 - DNA, 1205 bp, Zea mays
acagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggacatgttttttctgagttctacacctgcttgtcttgcttatgtgacggtggagtattgtgcctttaatatcaacctaatcatggactggttcatcactgt

SEQ ID NO: 8368 - DNA, 2436 bp, Zea mays
ccggcccccagtggctcgtagaacattcgagaacccctcgcctcctcccccaacgataaaatcctcaccgcgccgcaacgcatcttcgccccacaaaccctcgtctcgtgccactttctcagtcccctctagccgccgcctaccgctcgcgctctcctcgcgttcgggaaggtcgtttcgccatggccttcggagacggagacgttcgccttccaggcggagatcaaccagctgctctcgctcatcatcaacaccttctactccaacaaggagatcttcctcagggagctcatctccaactcctccgatgccttggacaagatcaggtttgagagtttgacggacaagaccaagctggatgcacagccagagctgttcatccacattgtccccgacaaggccaacaacacgctgacaatcatcgacagcggcattggtatgaccaagtcagaccttgtgaacaaccttggtaccattgcgcggtcaggcacgaaggaattcatggaggcacttgctgctggtgctgatgtgtccatgattggccagtttggtgtcggtttctactctgcctaccttgttgcagagagggttgtcgtgaccactaagcacaatgatgatgagcagtacgtgtgggagtctcaggctggtggctccttcactgtcgcacgtgatacctctggggagcaacttggcaggggtacaaagatgaccctctacctcaaggatgatcagttggagtaccttgaggagcgccgcctcaaggatctgatcaagaagcactccgagttcatcagctacccaatctctctctggattgagaagaccactgagaaggagatctctgatgatgaagatgaggaggataagaaggatgaggagggtaaggttgaggatgttgatgatgaaaaggaagaaaaggaaaagaagaagaagaagatcaaggaggtttctcatgagtggcaattggtaaacaagcagaagccaatctggatgaggaagcctgaggagattaccaaagaagagtatgctgctttctacaagagcttgaccaacgactgggaggagcatcttgccgtgaagcacttctctgttgagggccagcttgagttcaaggctgtactctttgtgccaaagcgggcccccttcgacctctttgacaccaggaagaagcagaacaacatcaagctctatgtgcgacgtgtcttcatcatggacaactgtgaggagctgatcccagagtggctgagctttgtcaagggtattgttgactctgaggatcttcccctcaacatctctcgtgagactctccagcagaacaagatcctcaaggtcatccgcaagaatcttgtcaagaagtgcgttgagctgttttttgagattgcggagaacaaggaggactacaacaagttctatgaggccttctccaagaacctcaagcttggcatccacgaggactccacgaacaggaccaagattgctgagctcctgaggtaccactcgaccaagagcggggatgagctgaccagcctcaaggattatgtgaccaggatgaaggagggccagaacgacatcttctacatcactggtgagagcaagaaggctgtggagaactccccgttccttgagaagctgaagaagaggggctatgaggtgctgttcatggtggatgccattgacgagtattctattggacagctgaaggagtttgagggcaagaagctcgtctctgccaccaaggagggcctgaagctggacgagagtgaggatgagaagaagcgcaaggaggagctcaaggagaagtttgagggcctctgcaaggtcatcaaggaggtgctgggcgacaaggtggagaaggtggtggtctccgaccgcgtggtggactccccctgctgcctggtgaccggcgagtacggttggaccgccaacatggagcggatcatgaaagcccaggcgctgagggactccagcatgtctgggtacatgtcctccaagaagacgatggagatcaaccccgagaacgccatcatggaggagctccgcaagcgtgccgaggctgacaagaacgacaagtccgttaaggaccttgtcatgctgctgttcgagacggcgctgctcacttctggctttagcctcgacgatcccaacacctttggcagccgcatccaccgcatgctcaagctgggcctgagcatcgacgaggacgaggaggctccggaggctgacaccgacatgccccctctggaggatgacgctggcgagagcaagatggaggaggtcgactaagctgggtttattcttatggaggaaagagagagaacatcgggtctgttctgtgggtcttaccacttatgctattatgcaatctgttgttggtatgctagtgctactattgtctctgctgtcttctagttaattttgttgttgttttgcgtggtc

SEQ ID NO: 8369 - DNA, 1403 bp, Zea mays
ccccctcgtcgcaaggccacaaccactccactcctccccatccctagctagccactagggtttgccagcctttgcagcgtcgcgctcgcgtctcatgcccttgcccatcgacggtagacgagagcgagcggtctgtgttcgtggagcaggggccggcgccatggagatcaacatcgtagacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaagaatttcctgtatcagttatgcaaaggagttgcacactgccatagccatggtgtccttcaccgggatttaaagccacaaaacctgctggtggacaaggagaagggtatactgaagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttgctgaaatggcccgacggcaggctctctttcctggtgactcggagttgcaacagttgcttcacatcttcaggttgctgggaacacctactgaggaacagtggcctggagtgagtgatttaagggactggcatgagtttccacagtggaagccccagggtttggcacgtgtcgtcccaacactggaacctgaaggagttgaccttctatcgaaaatgcttcagcttgatccttcaaacaggatatcagctttagctgcgatggagcatccctactttaacagccttgacaagtcccagttctagccgttgtactatgtggttcagaaggcgctaccctcgtacagagagatttccaatggtgttatgaatctcaattgccatctaggcaactggttcatgattttaccaatctgttagtgagtgaaaatcgtgcgagggtcatatgtgttccccttgtcttaaaaatctggtgtggtgtagaacaagagttacctgtgggaggcctgtgataatgccctttatgtctcaacatccattttcgtgcattccatgttcttcaatacggacttgaaacaggaattctgattttcttattactaccttcaagtttcagcttttt

SEQ ID NO: 8370 - DNA, 735 bp, Zea mays
gtttgttagcgtgacgtgcgtgaggagtctggagtcggacggaatcgaaaaggcgaaaactcagtgtctcgagtttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttgggcgtatccaccgtcagctgaagcaaaggactcaggcaaatggtcgcgttggtgccaccgcagccgtctactccgctgccatcctggagtacttgactgccgaggttctggagctggctgggaatgctagcaaggatctgaaggtgaagcgtatcacccctcgccatttgcagctagccattcgtggagacgaggagctggacaccctcatcaagggcaccatcgcaggcggaggtgtcatcccgcacattcacaagtccctgatcaacaagtcctccaaggagtgaagactaggggatgtgcatctttagtttaaactagacttctgtgcgctcctcggcgagtccttgtcatcctgtaggttttagttgagctgtcaggttggagctcctctgtgtaacgcttgcctggtactgcttcatcagttatttggttattgtgtttgtgttgagttgttaacttcaggggtgcaaacctggatgcttatttagttatgtgactactgctattcggttt

SEQ ID NO: 8371 - DNA, 1002 bp, Zea mays
ggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagtcgaac

SEQ ID NO: 8372 - DNA, 1816 bp, Zea mays
tctcgttccatttccccatctcccagatccaattcgcgagttcttcctcctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaat

SEQ ID NO: 8373 - DNA, 1592 bp, Zea mays
gagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttttcaatctctctagattctgacgagtggtggtctgcactcgttgtaatgtcgtttgcctaaactgattttgatggaacaggt

SEQ ID NO: 8374 - DNA, 1562 bp, Zea mays
gagatcggctgcctcgatttctcttcgagtgccaagcagtactgctagttctacttctgtacttcagcagtagtaggccgctgttgctacaattttgactgactgagatgggaatcctctgcctcggtgcttcctccacactgctctgcggggaggacaggaacaacgtactcggcctcggctgcggcaacgagctggtggaggtggggagcggccatgacggcttggactccgtcgtcggcgccgtgttccccgtggacacagatgaggccgtgcgggcgttgttggagaaggagacggaccacaagcctcaagacggctatgcggagaggctggagcgcggcggattggagtactcctggaggagagacgccatggattggatttgcaaggtccattcgtactacaggtttggaccactcagtctttaccttgctgtgaattacctggatagattcctctcctcatatgatctcccacacgataagccttggatgcgacagttgttgtcagttgcttgcctagctctcgctgtcaagatggaggagaccgtgctccctcttcctgtggaccttcaggtctgcgatgtgaaatttgagtttgaagcaaggactattgggaggatggagcttcttgtgctggccaccctgaaatggagaatgcaggctgtgacccccttcactttcatcagctacttcctcgacaagttcaatggtgggaagccgccgagtatggcactagcgtcacggtgcaccgagatcataattggcacactcaaaggctctacattcttgtcattcagaccatctgagattgccgcggcctcagctctagcagcagtttctgagaatcaggttgttggctcctcgagtgctctttcagcatctgaagtccctataaataaggagatgattgctagatgctatgagctgttgcaagagcaagcgctggtgaggaagacagggcacatcaatggaagcccttcagtgccgcaaagcccgattggcgtgctggatgcaacatgcttcagctttaggagtgaagatgtaagactaggatcatcgcaatcaaacaacatcagtagtagtagtaacgacaatcaagtttctaagaggagaaggctaagcatatcaccaatctgagtagatcaaaactctgttggcagtgtcgcattgtgcgcttggttatgcattgatcatcttaacctcagagcttgtcagagcaacaagtagtggtacaaaaggacccagtgaagcattgtaacaagcagaggatggtgacagtaataagttagaagcagcttcttgatctctgcgacgaaataggtgacgaggaacgtttcttcctctagtaactttgaatccccttcctccccggtccctttgttttattccttttcctttttatcggtatctcaaggcatttgtggggactggggagatatatgtggatatgagattggagacgtgaggattaaagagagagagagggagggagggagataaaaaaaaaacaggtttgttcctttgttctctgccaatatacaaaaaaactgtcgtgcg

SEQ ID NO: 8375 - DNA, 1164 bp, Zea mays
ccccattcgaacgccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaccttttccatcgctgtttattgtgagtggtcctatatc

SEQ ID NO: 8376 - DNA, 809 bp, Zea mays
agaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 8377 - DNA, 1178 bp, Zea mays
gggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccaaggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgacgagaagaacgtgctgtccctgtggtttgacgggctcaagctgctcgtcgtcaccgacggggacaagggatgcaggtacttcaccaaggacttcaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatccttttttttattttattttattttatttttagcttggatcagttggggttttgaacattgctagtgtcgtgtgattgggaaggctaatgtgatgccttcgatgcagagttttcaatgaatgccttggtgcaaacgtacgattgtgtaataatgccttctattgatcagcgactccaatagtccaatgtgcc

SEQ ID NO: 8378 - DNA, 2242 bp, Zea mays
ggtttccatccgcactcgatccgcctcaaccacccgctaattcctcctagttctagacttctagtctcctctctctctctctctctctctctctctctctctctcctgcgccgactcatcttcaccctcgtatcacctccctgctgctgctgacgctgctgccggcaagatcaaatcgttcaaaaggtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgagaacaaaagcgataggaggctctgtctcaacatttgcgttggttataagaggcggttgccatttcgatgacaaagttagaaatgctcagaatgctggattcaaggctgctgtagtatatgatactgaagacaacggtatccttgtttcaatggctggaagctcgtctggagtccacatatatgcagtgtttgtctctaaagcgtcaggggaggagctgaagaaatattcaggccaaactgacgcagagttgtggataataccaacatacgcgaactcggcttggtcaatcatggcaatttcatttatatcactgcttgttatgtctgctatcctagccgcgtgtttctttgcgaggagacaccagataagacgggacagggctcgacttccccaaactcgggagttccatggaatgaacagccggttagttaaagcaatgccaagtcttattttcacgaaagtgcaagaagacgactgcacatcagcaacatgcgccatttgcttggaagactacagtgctggagaaaagataagggttctaccttgtcgacacaagttccacgcagcctgtgtggacctatggctcacctcctggagaacattctgccctgtatgcaagcgggacgcgaatgctggaacaccagagccccctgtatcagagtcgacgcctttgctctcatcatccgccattcgcttaccagaaccaaccgcttcggtttccttccggtctacagtggcagcagcagcagcagcgtctccccccaggccaatcagccggcatccgtcgccatcacggtccatatcccgcaagcactccgtttcaggttccagcatccctggcacccctatccccaggtttcacgcaagctcatcatctcctacctgcacaagtggaagcagtttggacctcgcaaacatgccgtcgtctccatggcctcgcgcttcgcaccttgcatctgctcactcttcgtgcggtggccgcctgtccccgccgatccacatcaggaatacctctgcagcgcacgtctcgcgctctgcctatggatctcccagccgttacgtaggctcgtcgcacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaacattgatggtggctccagtaaagctcccggccgtgaggaatcttacatggcaccgaattgacatgtggatttgagctcctcagttcaccatgatgatgagagaaaaaaggtgcgacagaattgcttgtaagaagagagaattgcaccccccagaatgtgtggcttcatcttgaagaagcaaatgcccatgtcgggtttcaccagcgtttagcgtgtactgatacagctctgtagtaattctagttgctgtttgtctatcgaggtttgagccggtagcattccttcctctcttttttgttttcctaattttgaattagttatatgacagacaaggttttcaagaaaagaaataacaagttttacccctgcatttttacagagaggtatgttgaactc

SEQ ID NO: 8379 - DNA, 1564 bp, Zea mays
gccgttgaagccaaaatttattacgataaaattttgatcctttcatttgttggacattggatcaactggtgctgttatacatagaaaggagttcattgtaatttctcatctatatttagtggtgccataatcatttttccactggtgttcggcaataatgtcggagagcgagttagcagtaataaaaccagaggcgttaaagacttatatctggcttcagtgctttgatggttccattcagcaagtggaggaggaggttgcaatgttctgccccatgatatgtcgtgaaattgtgaaaaatggcacagggtcgtccaaaaatcatgctattgcgctccctgaaagagttaatccagccagtttgagtttgattcttgactactgccggtttcatcaggttactgggcgctcaaacaaggagcggaagtcctttgatgaaaaatttgttaggatagaaacagaaagactctgcgaattgacttctgcagctgacagtctacagctaaagccacttgttgatcttactagtcgagctcttgctcgaattattgaaggaaagacacctgaggaaatccgtgacattttccacttaccagatgacttaacagaggaagagaagttggagcccctaaaaaatgtaaatgatgatcctaggattcgcctattgaaccggttgtacgcgaagaagcggaaagagctccaggagcgccagaagctgaaggatgtacaagtacaaaaggaggaaaaagatgagagatctttggatgagttactttgttttattaatggggatggaggttcaggaggtggggaaagtagtaccaagagtaagaaaaagaataaaagaaggaaggatcatgctaagaaccccgcaaaagctgactctgagtctgtaaatgtggagggagctgcttgtgtggttccgtgcaaagtggatagcagtaatgtttctagacttccatgccaaagtccagatatgcaagatgatgtcgagtacccctttgaagatgctgacctcgatgatggacttgatcctgcaatgaaagaagagcttgatagagaagttgaggactttgcaaggaggttgaattcagtttggagcgagtcacatattggtggtaatggttctgtgcagagatttcctgggtttaatcacaggtgagtgttaagctggcaagatctgaaggcagaagcagaggagatttgtgggcatacagcttggaagggattaaaggccaaacaggccaccttggctcctgtgtgttgtaaaaccttgataactcaggaaccaagcatgcagaaatgcgcaagttcccttggccattttcctgggaaggaggccacctagttgggatgaccctttttttttttctttgggaagggagggttagaggtctgtcttgactcaattttttgttttccttaactgctgtgttgccagttttcctgaataggggaagagaggagtgttgcctgttagctctgttacagatgtccatggaattctgttgtaacactgtattgtggtgcacatagaaatgtgattccctgtattgtggtgcgc

SEQ ID NO: 8380 - DNA, 1676 bp, Zea mays
gtgactggcgaggcaaaagcattgcgaccacagacagcgcgcgcttcaaggcctttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttttcaatctctctagattctgacgagtggtggtctgcactcgttgtaatgtcgtttgcctaaactgattttgatggaacaggt

SEQ ID NO: 8381 - DNA, 1225 bp, Zea mays
tccgcggtccgcgcccgtgcaccatctcgcctcgcattcccgaaagtatctgtattccttgatcaacatgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgccttcaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctcgaagggcgatgctggtgagggtcagtagcctggtaaacttagattgatggttcgacgtgtttctcaagcacatcgtgttggacgcccagtgctgacagaaggcttttgctgctccatgcattccaagcttctgccctttcgttcgcaccctcttcatgttgttggctggtagtggtcagatttagtcccattggtttagttggccctgggtccatctgaactgatgtattgttactgctatggaagtcattcctttagttttgctctggcagtggattgctgttgggtcgtgttttcagtctttattggttccgatcggacgctgttgcggcaaaccacccctgtagatactcttcacatgctgaagaaaactaccagcagccgtttagcctgaataattgttaaatgataggttaccgttgaggct

SEQ ID NO: 8382 - DNA, 1687 bp, Zea mays
ggcgaggcaaaagcattgcgaccacagacagcgcgcgcttcaaggcctttttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttttcaatctctctagattctgacgagtggtggtctgcactcgttgtaatgtcgtttgcctaaactgattttgatggaacaggtaatcttgctggtctt

SEQ ID NO: 8383 - DNA, 1812 bp, Zea mays
ctcgcgaaccccgacaatggccgcaaccgcggtgtcggtcgacgagaagctcgacaagcttcgcgccgaggtcgccaaactcagccagatcagcgagaacgagaaggccgggttcatcagcctcgtgtcacgctacctcagtggggaggcggagcagatcgagtggagcaagatccagaccccgaccgatgaggtagtggtgccgtacgataccctcacgtcgcctcctgaagatctcgaggagacgaagaagctgctggacaagctcgttgtgctcaagctcaacggagggctcgggacgaccatgggctgcaccggacccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagtcgacatcaagatcctgaaccatctgatcaataaccagaatgaatactgcatggaggttactccaaaaacattggctgatgttaaaggcggtactctcatctcttacgaaggaagagttcagcttttggagattgcccaagtacctgatgagcatgtgaatgagtttaaatcaatcgagaagtttaagatattcaacactaacaacttgtgggtgaaccttaaagctgtcaagagactagtagaggctgaggcacttaagatggaaattattccaaaccccaaggaagttgatggtgtgaaagtccttcaacttgaaactgcagctggtgcagctattcgtttctttgacaaagcgattggaattaatgttccccgctcaagatttctcccggtgaaggctacatctgatttattgcttgtgcagtctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctatgcttgccgtcaccagtttttcccaaggatttgtcaataggagcagccaacccaaatcactcccactgagctctaccttttgtaattctcgtgccattccgctcccgctgtgagggtcctgtgagcccgctagagaatatgactgtaatcttctttggtgcgtctgcccttctgtttttgtgcgccagggacgtatattttgctgaaatgatactaccatagctttgcgtgccggaggtgctatgtggtgtttctgtgcgtttggttgcaatgataggacgggatgagatgagaccctcaaattaggttgtttggttctgggtcaaagattgagacaagaatatcctagtattgtttcatgttgtccttt

SEQ ID NO: 8384 - DNA, 660 bp, Zea mays
cgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaatggaataggaaatgccgtgtttctt

SEQ ID NO: 8385 - DNA, 1172 bp, Zea mays
gcgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgatgttgaacaaaaaaaaaacccc

SEQ ID NO: 8386 - DNA, 1369 bp, Zea mays
ggcgagtgcggcgacagccagtcacacactcccactccctcgaccgctctcggccctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaggaaacgttccttgcttgcaccctcggctggtgcattgaatggcttcaggctttctttcttgtgcttgatgatatcatggatgactctcacactcgtcgcggccagccttgctggttcagggtgcctcaggttggcttaattgctgcgaatgacgggatcatccttcgcaaccatatctcacggatccttcggtgccactttaagggcaaaccttactatgctgatctccttgatttgttcaatgaggttgagttcaagacagcttcaggtcagcttctggaccttatcactacccatgagggagaaaaagatctaacaaagtataacataacagttcacggtcgaattgttcaatacaagacagcctattattcattttatctgccggttgcatgtgccctgctgctctctggcgagaatttggacaattatggtgatgtagagaacatccttgttgaaatgggaacatactttcaagtccaggatgactatctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaatccttcttgcacaagatctacaagaggcagaagtagggtgctcttggataaacgagctcaggagtcgttaccccttcgcatgcttgacataacgggacttcctcacctggttcctctagtatgatgtggagcgtctagttaaaaaaaatggatgtagtatgaagcaccttgctgctctgaatattaacaggcaattaaggcaaggtgctgtttcggtttggtggaccgcatgttgcagataataaattagttgttttgtc

SEQ ID NO: 8387 - DNA, 1225 bp, Zea mays
gccgacgcgctccgttcccctttccctttccgaagcttctcgaccccccatcccctccctgacatggccgacaacgcgaaggccgcggcggcgcatgcgaggccggagtcgtcgcaggaggaggaggaggactggaaggaggccgagggggacgtcgccgaagtcgaccgcgccgccaccaatggcgccggcgaggggggcgtgcccacagacaggccgatccgggtctacgccgacggcatctacgacctcttccacttcggccacgccaagtcgctggagcaggccaagaagtcgtttccaaacacatatcttcttgttggatgctgcaatgatgagttgacacataaattcaaaggaagaactgttatgactgaggatgagcgatatgagtcacttcgtcattgcaagtgggttgatgaagtcattccagatgctccatgggtggtgacagaagagttcttggataagcataacattgattttgttgctcatgattctctgccgtatgctgatgctagtggagctggtaacgatgtttatgaacatgtaaaaaagcttggtaagtttaaggagactcagcgcactgatgggatatcaacatcggacattataatgcggattgttaaagattataatgagtatgttatgcggaatctggccaggggctacactagaaaggatcttggtgttagttatgtcaaggaaaaacgactgcgagtgaacatgggacttaaaaacctgcgtgacagagtgaaacagcaccaagaaaaagtaggggagaagtggagcacggttgcaaaactccaggaagagtgggtggaaaatgcagaccgctgggtggctggtttcttagagaagtttgaggaagggtgccactcaatggggacagccatcaaggagaggatccaggagaggctcatcaaggcacaatccagcgactttggcagcctcctacagtacgacagctacgattctgatgaagccaaagaaaacgacgaggacgaagacgaagatgaactctttgaagacgtcaaggaatagcacctccgtacatatacaatggttttgtagctgcaaattgtgttgtgagtcagttgcctctctctggttggtgatctttatatatggtctcaaaggtaggtcaggttgcaatgtttgtagctgctcttggtgtttgttcaggcaacgcatggttgtaaaagctgtggaaagactcttgtgc

SEQ ID NO: 8388 - DNA, 1564 bp, Zea mays
gcttccttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacatatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctccatgcttgacgttt

SEQ ID NO: 8389 - DNA, 1590 bp, Zea mays
gttctggtgagcgagcgagcgagtgagagacctagctagactgaccggccgccggcaggccgagaacgaagcgcgtgtttgtgcatgagccatggcggaccagcagcagccacagcagcagccgcaggagatggacgttgatcgtaccggtggcctcgaactgcctccagggttccgcttccacccgagcgactttgagattgtcaacgactacctcacgaagaaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaagggcagggctcccaggggtgacaaaaccaactgggtgatgcacgagtacaggctcgaaggcagtggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgccatggacccggtggccccctactaccccaacccaaatgccggcgcggggatgatgccgcctatggcattggcaggtatgggtggcgccggcgggctccagatcaacggcgctctgttcggcaatccggtgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgagcaggctaatgccgccgagatctcgtcgatgatgtctgtgaccggcccagggtccgcgaccaccaccatagagatggatggcatatggaagtacaagtactgaaaaagtggatatggagtttggagacaaatgcatgaatatgcatgttatatctactatatctgcattgcattttgtgaaaatttgcatggttcctatatttctgcaataactagtcggtaagatatgtgtgcatgcatgtgctagtatatacatgcattgtatcattgcatgtgtggtatatgtgtgtgtcgtttggtcttagtaatccggggcatgatggtacccatacctggatttacatctgcttggtcgtgctgatgttgtgttgtaatttgtaaaaagcagattgaagttcggtacagtatattatcgtgaacctatat

SEQ ID NO: 8390 - DNA, 571 bp, Zea mays
gcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttc

SEQ ID NO: 8391 - DNA, 1143 bp, Zea mays
ggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccg

SEQ ID NO: 8392 - DNA, 827 bp, Zea mays
caactagcaacatagaaagcacaatagtgtaccaacaatggcagccaaaatattttgcctccttatgctccttggtctttctgcaagtgctgctacggcgaccattttcccgaaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttctagatt

SEQ ID NO: 8393 - DNA, 1882 bp, Zea mays
ggcctcacccttttccctggtgttgcaagttgcaacacacagcgtccggcgagatcggcgatcagaaaccacgagcccacccaccatccggaacgcgcgcgcgatgtgtcccgtcagaggcggtggttgttcttggccagcgtccgtcgtcggctctgtcacggcggcgctgctcctcgccgccgtcatcgtgcggctcttcgtcccccgtgcctgttcttcaggaattatcaaggggcggcggcaggtaggtgctggtgctgccggaggagcacggctccctgccggctcgctcgggtggccgctcctcggcgagacgctggcgttcatccgggccgcgtactcgcctcgcccggagtccttcgtcgagaaacgccgcgtcttgtacgggaaggtgttcaagtcgcacctgtgggggtcgccggcggtggtgagctcggacccggaggtgagccgcgcggtgctgcaggccgacgcgtcggcgttcgttccatggtacccgcgatcgctcatggagctgatggggcaatcgtccatcctagtgctcggcggcggcctccagcgccgggtgcacggcctcgcgggcgccttcttcaagtcgccgcagctcaaggcgcaggtcaccctggacatgcagcgccgcgtcggccgcgccatggacatgtggggcaggcgccatcggagcatgggcgacgacgacagcggtggtatgcccgtgcgtgtgcagaacgaggccaagtcgattgtgttcgaaatcctagtgagggcgctgatagggttagaggaaggggacaagatgcagtacctcaggcaacagtttcaagaattcattgccggtttgatatcacttccggttaagcttccggggactcaactctatagatccctcaaggctaagaagaggatgacaaagttgataaaaacgatcatccaagagaagaggaagaagatgatgtcggaaggcgacgaggatctgcgtggtgggactcatccacgtgacatgatcgacgtcctgctaggcaacggcaacgacgagctctccgacgagctgatatctgacaacatgatcgacttcatgatccctgcagaggactccgtgcccgtgctcatcacgctggccgtcaagtacctcagcgaatgcccactggctctgcagcaactcgaggaggagaacatggagctcaagaggcagaaatcaggcgcgggagaaaccctagaatggacagactacatgtcgctcgccttcacacagcacgtgatcacggagacgctgcggatgggcaacatcatcaacgggatcatgcggaaggcggtgcgagacgtggaggtgagaggccacctggtcccgaagggctggcgcgtcctcgtctacttccgcgccgtccacctcgacgccgccgtccacgacgacccgcacgccttcaacccctggaggtggaaggagaggcccgacgtcgtggccatgagcggcttcaccccgttcggcggcggccagaggctgtgccctgggctcgacctggcaaggctcgaggcctccatctttctgcaccatctcgtcaccaatttcaggtgggtggcggaggaggacaccgtcgtcaacttccccacggtgcggctcaagcgagggatgccaatcgcagtgacgcccagaacctgctgaacgcaacgcaacttgccaggcaaaaccatactatacatttatactccgtaatcaactaaagaggtgtgagaaataatacagtacatgcaagcatgtaatggagggcgaaattaaaagttggcacggcaaaggcgccgatggtatgccaaaagttcagtttgcaaattatatagtttaattgctattacactaggggcacccatgtctgatgcctcgtttatg

SEQ ID NO: 8394 - DNA, 1282 bp, Zea mays
tagccctttttttttttttttttttgccgattgtatcccctgtgattagcaataactaaaatagtgcaccaacagtaaggtacatacagcttcatagctgcaacagtcgtgcagacggcagctgcatttctgtgctgaatctaaaacagtgatgagaaactagactatgtacaacgaggcgaaaagctgccatgatacaaggccacgctcaagctcttcacagtggaagattattttgtggcccaaagggctgcagtgtttttagcagcaccatatagcactcggcggcggcttaagtcactcattcacctgtggcccaacctccgcgggcactacaggctctggcgatttcctcagccccaacctctgcaggtgcttcaggtgcttctctgcagctgccttatctgcagcttctcgcttctgcgccctcttcgcccgccttccagcgacatccttggatacagaccccgatcctgaccccgaaccagacactgacaccgacgccggagacgatgcggctttctctttcttcttcggagtcctggatggaccagcagccacatcagtattcactggcctcgcctctttcctgcctcccctgatgtacccattgtcaccccatctcctgttaccaatacggatgcttggggacctgctcatgtaataaaattcctcgtcaagatcatcttcgtcatcatcgtattggtactgctggtggagaaactcttcttcttccagagcctcttcctgagcctctacgatcagaggttcaaaccaagctgccctcagaaggaggcaaacactctcctcaaacaggtagtcatgtaagcagccgtcgagagagcggtgcacgctgaggaatccgaatggatgcttgcactgtggacagagagggttctccttgtaggatgcccacctcaaaatacaggtcacacagtaggcgtggtcgcaacccttgacgagggccgtctcctggagcgctatcctgtcgaggcagatggcgcacaccccgcaatccgccgccacccggtcgccgctgcttgtagccaccgctcccaccgccacctcgccgacggagacgcaggtgcgggcggcgatcggaacctcggatgaggaagaggaggacgcggcggcggcggcggccatggcggcggggatcgaggagggaggcgatcggacgagggggtcggtcggtgtcggggagggaggagcggatgtgagggcaggaaggggcgccttcgcgaacgaacgagcgcgtccggagaaaaaagcggacgcgtgg

SEQ ID NO: 8395 - DNA, 834 bp, Zea mays
agaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttctagattctt

SEQ ID NO: 8396 - DNA, 1306 bp, Zea mays
cacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctcggcgacgacgagttcggccgcatgctcgccgccatcctccgcgacaacggcgtcgacgacggcggcgtcgtcttcgactccggcgcgcgcaccgcgctcgccttcgtcaccctgcgcgccgacggggagcgcgagttcatgttctaccgcaaccccagcgctgacatgctcctcaccgccgacgagctcaacgtcgagctcatcaagagggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccagggatttccatggcgctgtgccttccttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaagggggcgatcccgtcgctgcccaccgaagcggaggtcttgcagctaatagagaaggcttagatcatcatcgtcctgtacgccatggttttcaccagcttctacttcttcgaattgtattggattctgatatggaacagaagaagaagcggctgccccatcttaccagccctttttgtttgccctagtttccccttgtgaaaagggtgttttgttttataaactctacttgcaataagcagagcctttttttaattatgtcagggtgcatttgatacgatcgaataatcatcaatccataattgtagcaattttttttt

SEQ ID NO: 8397 - DNA, 2704 bp, Zea mays
tttctaaaaaaaaaaactttattattgaactataactcataagcaatctaaaagagggcaccaccaatgatgggttgttgatctgtcgccgtctcgccaacagcaccaaccgcctcctagaactcgaccgccatggcgagccaaggcgagccgtcttcctccgatccgaaggggaagaaggattactcgacggcgatcctggagaggaagaagtcgccgaaccggctggtggtcgacgaggccaccaatgatgacaactccgtcgtcgctctgcacccggacaccatggagaggctccagctctttcgcggtgacacggtcctgctcaagggtaagaagagaaaggacactatctgcattgtgctcgcagacgagacgtgtgaggagccaaaggtccggatgaacaaggtcgtcaggaagaacttgagggttcggcttagtgatgtggtatctgtccatcaatgcccagatgtcaaatacgggaagcgtgtgcacatacttccaattgatgacaccattgaaggcatcactggcaacttatttgatgcctttctgaaaccatactttcttgaagcctatcgtcctttgaggaaaggagaccttttcctagtcaggggtggcatgagaagtgtagaattcaaagtcatagagactgatcctgcagagtattgtattgttgcaccagatacagaaatattctgtgagggtgagcctattaagagggaggatgaggaaagactcgatgaagttggctatgatgatgttggtggagttagaaagcagatggcccaaatcagagaactggttgaacttcccctgcgtcacccccagcttttcaagtctattggtgtgaagccaccaaagggcatattgctgtatgggcctcctggctctggcaagacccttattgctagagctgtagctaatgagacaggtgctttcttctttttgatcaatggaccagaaatcatgtcaaagctagcaggagaaagtgaaagcaacctcagaaaggcatttgaagaagctgagaaaaatgcaccttcaatcatttttattgatgagatagattccatagcacccaagagagaaaagacccatggagaagttgaaaggcgtattgtttcacagctcttgactcttatggatggcctcaagtctcgtgcacatgttattgttatgggtgccacaaaccgtccaaacagtatcgatcctgctcttagaaggtttggtcggtttgatcgtgagattgatatcggtgttccagatgaagttgggcgccttgaggttcttcggattcacacgaaaaacatgaagcttgctgaagatgttgacttggagatcattgcgaaggatactcatggttatgttggtgctgatcttgctgccctttgtactgaagctgctcttcaatgcattcgtgagaagatggatattatagatcttgaggatgagacaatagatgcggagatactgaactctatggctgtctcaaatgatcatttcaagactgcacttgggacaagcaacccatctgctctgcgtgaaactgttgttgaagtgccaaatgtctcttgggaagatattggtggcctggaaaatgttaagagggagctacaggagactgttcaatatccagtggagcatccagagaaatttgaaaagtttggcatgtctccttcaaagggtgttttgttttatggccctcctggctgtggcaagactttgttggccaaggcaattgccaatgaatgccaagctaacttcattagtgtgaagggtcctgaactgcttaccatgtggtttggtgagagtgaggccaatgtccgtgagatttttgacaaggctaggcagtctgctccatgtgtcctcttttttgatgagctcgactccattgctactcagagaggaagcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgggcgtcttgatcagcttatctatattcctctgcccgatgagcagtccaggcttcagatcttcaaagcctgtctcaggaagtctcctgtggccaaggatgttgacttgaatgctctcgccaaatacacccagggtttcagcggtgcagatatcacagagatctgccagcgcgcgtgcaagtatgccatcagggagaacatcgagaaggatatcgagagggagaggcgcagcaaagacaaccccgaggctatggaggaagacgaggtagacgacatcgctgagatcaaggctgctcacttcgaggagtccatgaagtacgcccgtcgcagcgtgagtgacgccgacatccgcaagtaccaggccttcgcccagacactccagcagtcccgcgggtttggcagcgagttccggttccccgaccaaccgacggcagctgctgctgcggccgatcccttcgcatccgctgcagcagcagctgacgatgatgacttatacagttaaattagcagtcctgtgttgtgacgcatattgagtactttgcttcgttatatgcttattatagtagactacgtgcaaaacgcggagtcgctgtacctatataatacttaagttaatattttggtacgatcctctgaatcgtgccatgagc

SEQ ID NO: 8398 - DNA, 1069 bp, Zea mays
gctcgcccagcagcagggagcagccatgccaggggaccacggctccaagggcgacatctccttcgccggacgcttcacggccagcgccatcgcagcatgcttcgcagagatatgtaccatcccgctcgacacggccaaggtcaggcggcactacgagctgctggtggaggacgtcgacggcatcgagtcgggccgcgtcccgcttccggcgtacgcggctgacggcgctgccgaggaagggggcggtggcgggaagaagggaagtggcggaggagggacccatggggacaaggggtcggcgaagtccgccgagcaggagcgtaggaagggcatcgcctggacagaggacgagcacagattgttcctccttggacttgaaaagtatggcaaaggtgactggcggagcatctcgcggaactttgtgatctcaaggacgccgactcaagtagctagtcatgcacagaagtactttatccgtctgaactcaatgaacagagaaaggcggcgatcaagtatacatgacatcaccagtgtgaacaatggagatccatctactgcacagggtccaatcacaggccaaacaaatggtcaggctgcaaatcctggaaaaccatctaagcaatccccgcagccagcgaatacacctccaggcgtcgatgcttatggcacaacaattggacagccagttggtggcccccttgtctcagctgttggaactcccgttacactacctgtttccgctccacctcatctggcctatggcatgcgtgccccggttccaggagccgtagtacctggtgctccagtaaacattgctccgatgccctatccaatgccacccccaccatctcatgggtgacagggtgagggacacatttcaaatgctgtgtagcgtctaaacaaacccataatctccccctatgccagcattttgcgggtgtgctgctatgtctcaataaagcaatgccaataaacccttgtacattacaaactgttgtcacatgttgcattgaggacattgcagattgtgtactttgtgttgcatgcaaactttttcatgtacatctcc

SEQ ID NO: 8399 - DNA, 832 bp, Zea mays
ttatttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacctcaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 8400 - DNA, 1264 bp, Zea mays
ctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttattaaatttgcttgtttggttttaccttgtgaaagggggtgtttgtctgagtttat

SEQ ID NO: 8401 - DNA, 1349 bp, Zea mays
gcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacgagatgtttttgattg

SEQ ID NO: 8402 - DNA, 1688 bp, Zea mays
cgaggcaaaagcattgcgaccacagacagcgcgcgcttcaaggcctttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttttcaatctctctagattctgacgagtggtggtctgcactcgttgtaatgtcgtttgcctaaactgattttgatggaacaggtaatcttgctggtcttgccat

SEQ ID NO: 8403 - DNA, 831 bp, Zea mays
attttcgtcacccctgacgctcgacgcctctcctcctctcctcccccacccgtccatcgccccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcagaaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaatgtaccgtggttgtgaaccggtcaatgtgatctgaaataaaacattgcgtgccaagtttgtgtt

SEQ ID NO: 8404 - DNA, 1131 bp, Zea mays; identical to SEQ ID NO: 8218

SEQ ID NO: 8405 - DNA, 830 bp, Zea mays
atttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgttgcctacccccagcaatttcttccattcaaccaactggcagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacctagcagtgttctaccaacaacccatcattggtggtgccctcttttagatttcttatgagttatagttcaataataaagttttttgtctgatgtttgtggcttcccagaaataagaaagtacatttct

SEQ ID NO: 8406 - DNA, 825 bp, Zea mays
ccaactagcaacatagaaagcacaatagtgtaccaacaatggcagccaaaatattttgcctccttatgctccttggtctttctgcaagtgctgctacggcgaccattttcccgaaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcatactctcagcaacatcagtttcttccattcaaccaactggctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataatgaagttttttggatgatgtttgtggcgtcccagaaataagaaagtacatttctag

SEQ ID NO: 8407 - DNA, 829 bp, Zea mays
ttgagaccaactagcaacatagaaagcacaatagtgtaccaacaatggcagccaaaatattttgcctccttatgctccttggtctttctgcaagtgctgctacggcgaccattttcccgaaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttct

SEQ ID NO: 8408 - DNA, 816 bp, Zea mays
gcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtttcttccattcaaccaactaggttcattgaactctgcttcttatttgcaacaacaacaactaccattcagccagctacctgctgcctacccccagcaatttcttccattcaaccaactagcagcattgaactctcctgcttatttacagcagcaacaactactaccattcagccagctagctggtgtgagccctgctaccttcttgacacaaccacagttgttgccgttctaccagcacgttgcgcctaacgctggcaccctcttacaattgcaacaattgctgccattcaaccaacttgctttgacaaacccagcagtgttctaccaacaacccatcattggtggtgcccttttttagatttcttatgagttatagttcaataataaagttttttatctgatgtttgtggcttcccagaaataagaaagtacatttct

SEQ ID NO: 8409 - DNA, 1044 bp, Zea mays
gccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttggg

SEQ ID NO: 8410 - DNA, 1939 bp, Zea mays
gtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgctgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgagcacttccctagggaatgtcggggggatgaacaacggcaacctgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaagtgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacaacaacgaactcatggggacaggtaggctgcaaaggggacttagtggtggtctggatgacattgtcgtggacatgtttaggccggaccgcgcagacgatggcgtctccttcattgatggggactgggaactggtctagcaagtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagcc

SEQ ID NO: 8411 - DNA, 1667 bp, Zea mays
cgcggcgccggcgcgtcgggtcgtgcccatcacgttgtctccactccgtcgcctctcctctcctctccgtccctgcgccacgcgggggagattaaagcgaagcgcctccccgctcacctctcctctcgtcgtgcgttggatcaaagtatcaaaccaatctcccctcgccgtccggccggcgtgcgcgcggggcctctttttttggagccttgcgccgcggcccgttcctcctgtccgaaataatccgcctcgacgtgttcgcctccccctccccctccctctctcccctcccctcgcgactcgtctcgtgcgtgactgcgtgctcgctctccttttcgctgcgctcatctcggtatctgtgccagcgctcgcctctccccgccggcccgccctccttcctttccttgtctagccgaaggccgaagccactgcgcgcgcgtgcgtgcgacgatgtcgtcggcggtggaggccatctcctgccccaaggtcgacgtccccgccggcccggagccgggggagccggccaaggaagcggcgccgcccgcggagcactgcgacacggcgcccaacggcaagtgcgcgccgcgttgtcacggggaggaggaggaggaggaggaggacgaggaggacgaggagaaggcccccaaggccatcgacctcggtcccatggtcagcatcaaggagcagctcgagaaggacaaggacgacgagagcctgcggcgatggaaggagcagctcctcggcggcgtggacttgaactccgtgggagagacgctggagccggacgtgaagataatgagcctgtccatcctgtcgcccgggcggcccgacatcgtgctgccgctgccggtggagcccaacggcaagggcgtgtggttcaccctcaaggaaggctccccgtaccggctcaagttcaccttctccgtcagcaacaacatcgtctccggcctccgctacaccaacaccgtctggaagacggggctcaaagttgacagagccaaggagatgctcggcacgttcagcccccagctggagccctacacgtacgtgacgccggaggacaccaccccgtcgggaatgtttgcccgggggtcctactctgccaggaccaagttcctcgacgacgaccgcaagtgctacctggagatcaactacaccttcgacatccgccgggagtggccgtcgacgagctgaccatccttccctccctccatcggtggcctgagcagaccagtcgtttcgttctgtgttcttccttttctatgttgcctcgtcctgtcctgtcactaggttttttgtttgttcaccgtcagcttgttcgctgcggcttgctgcggctgcaatccggctgcggctgcggcttctacagtatttttctctctatggattgcagctgcagcagtccaaacagctgcaacagtgtcggcttgtagccagccgaacacgccccgtgttgctgcgtgcgtgacgcacggtgcgtctatgtgccctttcccatgcgccagttgtctgctgtgttgacaccgttactagacagtgcaaatgtcaggtcggtctaccggactgtgcgtgcgtcagcgtgttcaacttgtcgatcagggtctcgttttttccgaaccgcctgttgagttaagacttcagagcaatgaagctgcgttctgcgtagt

SEQ ID NO: 8412 - DNA, 1264 bp, Gossypium hirsutum
tggaataagaaaccaaagggagtggcagtggaagatggccgctagcagcgatcctaacccggagggttccgatgagcagcagaaacgatccgagatatacacttacgaggccccttggcatatctacgccatgaactggagtgtccgccgcgacaagaaataccgtctcgccatcgccagcttgctcgagcattacaacaaccgccttgagattgtccagctcgatgactccaatggcgagatccgatcggacccaaatctctccttcgatcatccttatcccccgaccaagaccatcttcatccccgacaaggagtgccagaaacccgaccttctcgccacgtcctccgacttcctccgcatttggcgcatctccgatgaccactcccgcgtcgacctcaagtctctccttaatggcaataagaacagtgaattctgcggtcctcttacctccttcgactggaatgaggcggagcccaagcgaatcggcacctcctccattgatacgacttgtactatatgggatatcgagagggagacggtggatacccagcttatcgcccacgataaggaggtttatgatattgcctggggcggcgtcggtgtttttgcttccgtctctgctgatgggtccgttagggttttcgacctgcgcgacaaggagcactccactatcatttatgaaagttcggagcccgatactccgcttgtacggttggggtggaacaagcaggacccgagatatatggctactataattatggacagtgctaaggttgttgttttggatatccgcttcccgacactgccggtagttgagctgcagaggcaccaggctagcgtcaatgccatcgcatgggcaccccacagctcttgccacatttgcaccgccggggatgattcccaggccttgatttgggacttgtcctccatgagtcagcctgtggagggtgggcttgaccccatccttgcctacaccgctggggctgaaatcgagcagttacagtggtcatcttcccagcctgattgggttgccatcgccttctccaccaagcttcagattctcagggtatgagtgaatgggattggtatattgggtcgtattcaatgctaaattgctaattcatagtctagtaattgtactcagatctagaggaataacaagattgttgctgtcgttgtgtctgagctgactaaaagtcccaaaactgttttggttttcctgttgtttcgtttgtcttcaacatgtttggatagttgattg

SEQ ID NO: 8413 - DNA, 980 bp, Glycine max; identical to SEQ ID NO: 8106

SEQ ID NO: 8414 - DNA, 557 bp, Glycine max
gatcacatttaaaatcaaaacaacaaattttcagactcaacaagcttcgaaccaaatcttattgagaaaatgtctggtcgtggaaagggtggaaagggtttgggaaagggaggtgccaagaggcacaggaaggttcttcgtgacaacatccagggcatcacgaaacctgcgattcgtaggttagcgagaagaggtggcgtgaagaggatcagtggtttgatctacgaggaaaccagaggagttctgaagatattcttggagaacgtgattcgcgatgctgtgacctacactgagcacgctaggaggaagacggttactgctatggatgttgtttatgctcttaagaggcagggaaggaccctctatggttttggaggctaaaaagttcttagtgttattggattctattgcagcgaaaaaatacctgttcttttgaatcggtgtgatgttttggtttaggtttgttctgtaagatatgaagtttattctgttctgttctgcatagaaaatgtacacctttaattgaaattaaccgaaggagcaacgttttcgtgctt

SEQ ID NO: 8415 - DNA, 694 bp, Glycine max
gaggaccaagaagaagaaacaacctcaaaatccctttcttgtgtcgattagattactttcacaccagagtcgttcgagtacttcaccttctttctctctaagcgcaaaacctcgtactgtttttggcggttaaggatgtcggggaaaggagcgaaggggttgatcacaggcaaaacctccgccgccaacaaagacaaggacaagaagaaacccatctcgcgttcttctcgtgccggccttcagttcccagttggtcgtatccaccggcttttgaagtcaaggacaaccgctaatggtagagttggggccacagctgctgtctactctgctgctatcttggagtatctcactgctgaagtattggagctggcagggaatgctagcaaggatctcaaggtcaaacgtattactccccggcatttacaactagcaatccgcggggatgaagagttggataccctgataaaaggaacaattgctggaggaggagtgattcctcacattcacaagtctcttatcaacaagtcttccaaggagtagattactagtgaataatagcttgcttgatggaaaatttctctctactaattgtgtaatttttgcatggcgcttgaaaaacaaagtagggccttttatttatgactttgttgcctgttgttgatcatggatataatatttagtctttctctttgcg

SEQ ID NO: 8416 - DNA, 1298 bp, Glycine max
ctcttctaaaacttaccaacacaacaaaatcgagtttccaataaagagttttgttgaaatggaaaacgttccggcggtgtgtaaggaagatgatcagatggatttgcctcccggatttcgattccacccgacggatgaagagctcataagccattacctctacaagaaggtcattgacaccaagttctgcgccagggcaattggagaagtggacctcaacaagtccgagccttgggatttgccatggaaagccaaaatgggagaaaaagagtggtactttttctgtgtgagagacagaaaataccccactggcttgagaaccaacagggccacagaagctgggtactggaaggccacagggaaagacaaagagattttcagaggaaaatctttggttggaatgaagaaaactctggttttctacagaggtcgagcacccaaaggagagaaaagcaattgggtcatgcacgagtaccgactcgagggaaaattctctgctcacaacctcccaaaaactgcaaagaacgagtgggtgatttgcagggtgtttcagaagagttcagctgggaagaaaactcatatctcggggataatgaggttggactcttttgctaatgaattgggttcttctgctctgccacccctttcagattcttcgccttctattggcaacactaaacctctgaatgattcggcttacgtgccctgcttctccaatccaattgatgttcaaagaaaccaagaaggtgtcttcgattccttcaccaactctatgtatggggtttcttcaaatcctatggacattcttcccagaatgccaccttctggctccttctactccactcaaggtgttcaagctgcgcctaattttgcatttcctggttctgtttacactcttcaggaccacaccatcctgagagctttgtgtgaaaacaatggttacaagccagagagggacatgatcagtgtttcgcaggaaacgggtctaactactgacatcaacgctgaaacctcttcaaattttgatgtgggttggaggccctttgagaatcacaatcatgcatctgtttctgttgccccattggatcttgatggtttgtggaattactaaaagtttaaataaaaggaacaattacagtgaaaagtgaaattaaccccacttttgagctgaaaggaagaggaacaacaagagcctcgggtggggttgatactgttgttgtttctctgaatagattttatctaagacatgtaattactgaagcatatgttgttaagtgtaagaattaagaaatgttgtg

SEQ ID NO: 8417 - DNA, 701 bp, Arabidopsis thaliana
gctcgaagaaattgattcatcacgaagcgaaatcatacaaagatctagaagaaggaaacaacaatttcaagagacatggcaggcaaaggtggaaaaggactcgtagctgcgaagacgatggctgctaacaaggacaaagacaaggacaagaagaaacccatctctcgctctgctcgtgctggtattcagtttccagttggacgaattcacaggcaactgaagacccgagtctcggcacatggcagagttggtgccactgcagccgtctacacagcttcaatcctggagtatctgacagcagaggttcttgagttggctgggaatgcgagcaaggatctcaaagtgaagaggataacgccaaggcatctgcagttggcgattagaggagatgaggagctggacacactcatcaagggaacgattgctggaggtggtgtgatccctcacatccacaagtctctcatcaacaaaaccaccaaggagtgatgtgtagctttttatggtgtttgtatttctgtagtcttggactcattttcctttatccttttcttagttctttgactagtgttgacctcttctggacatcctcaggtgtacattagttaatttgaactctttaggttccttgttcaatcatatgttctctttctatgctattgtgatttgcttattatgttttcaagtgaaccgttttctgtttt

SEQ ID NO: 8418 - DNA, 1938 bp, Arabidopsis thaliana
ctactactcatattgcttatattttcctacaacactctctcaacaaaaaaacaaaaaaaaaagacgttctttctttgtttgtatttagaagaaaaatggctaccaattacaacgagaagcttcttcttaattatgttcccgtttacgttatgcttccgttgggagttgtgaatgtggaaaatgtatttgcggacccagaaacgcttgaaacgcagcttaaacgtctcaaagaagaagctggcgttgatggcgttatggtcgatgtttggtggggaatcatagaatccaaaggtcccaaacaatatgattggacggcctacaaaacgctgttccagctgatcgcacgtttgggactcaaaatccaagcaatcatgtcttttcaccaatgtggtggaaacgttggcgacatcgttactatcccgatcccacaatgggttcgcgatgtcggtgacaatgatcccgatatctactacactaaccgtaaaggaactagagacatcgagtatctctcaatcggtgttgataatcttcccctatttgccggaagaaccgctgttcagttgtacagtgattacatgagtagcttcaaagaaaacatggcggatttgatagaagctggggtgattgttgacatcgaagtcggacttggcccggccggtgaactacgttatccttcttacccccaaagccaaggttgggtgtttcccggcatcggagaattccagtgttatgacaagtacttgaagaaagatttcaaggaagcggcggcgaaagcagggcaccctgagtgggacttgccagaggacgccggagaatacaatgacaagccggaggagactggatttttcaagaaggatgggacttatgtctcggagaaggggaagtttttcatgacatggtactcgaacaaactaatttttcatggagatcagatcttaggagaagccaacaagatctttgctggacttaaagttaacttggctgccaaggtttctgggattcactggttgtacaaccaccacagccacgctgcggagttgactgctggatattacaaccttttcaagagagatggttaccgtccgatcgcccggatgctctcaaaacactacggcattctcaacttcacttgccttgagatgaaagataccgacaatacagctgaagccctaagtgctcctcaagaacttgttcaagaggtactgagcaaggcatggaaagaaggtatagaagttgcgggtgagaacgcattagagacctatggagccaaaggttacaatcagattcttcttaacgcgaggcctaacggggttaacccaaacggtaagccgaagcttagaatgtacggatttacttaccttcggttatccgatactgtctttcaagaaaacaactttgagctgtttaagaagttggtgaggaaaatgcacgctgatcaagattattgtggagacgcagcgaagtacgggcatgagattgtgccgttgaaaacgtcgaattcgcagctgacgctggaggatatcgccgacgcggctcagccaagtggagcatttaagtgggactctgaaaccgatttgaaggtcgacggttagttatattttatatgatcgatcgtctaatcacaaagaaagtaagggaaagaatcaaggaagtaagaataagaagataataaataaagagaataagaagaggcatttgcaactttaagaggttaaaatttcttaaatgagtctgagtttcgttgtgtgttttgggtgtaccataagaaataaaacgtacggggttgctatgtattttgtgaagtgtgtatttctggttgaatattagtctgcgtaataaaaaaaagtatgtgtagtaaaaataaataactgttgccagtaaaataatgcatcattgtcactgtattgccagaatatatatattactttttaaggttgt

SEQ ID NO: 8419 - DNA, 1009 bp, Arabidopsis thaliana
gaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaaggtatgtactctcctattaatcataaacaaaaatacaaaatcattcaaaaacacaaacatatagttttttctaacctttttagcaaaaaggtaaaataatatttctggaacttacggaagatgataaaaaaaaaatatttgtggttttggtaatgtaatttatcaggattatttaattatctgtgtggggttaaaattgtaaattttgaactttggggaatccggtgaaaattttgaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagt

SEQ ID NO: 8420 - DNA, 857 bp, Arabidopsis thaliana
caaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgct

SEQ ID NO: 8421 - DNA, 1658 bp, Arabidopsis thaliana
ctactttgtcaattcctatactttcactctcttccaattatataatctctggtccatagaaaacatcggtctcttgtcaccgttgattttatttggtcaaaatcattcttcttctcgctgaataatcgttgatttcacttcttcttctggtcttaaaaaaattcaagatctatacgagaaaacacaaaacaagtaaaactttttcaaccgtttttcctgtcggtaaagtttggattcttcttagtaaattttggtcttattgtcgaccaaaagaagaagatggtcgttcagaatgttcaagatttggatgttcttccgaaacatagctcggattcattcgatgatgatggtcgtcccaagcgaaccgggacggtgtggacagcaagtgcacacataataacagcagtaattgggtcaggagtgttgtcattggcatgggccgttgctcagattggttggattggtggtccagtggctatgttactcttttctttcgttactttttacacatctacccttctctgttcttgttaccgatctggtgactctgttaccggcaaaagaaactacacttacatggacgctattcactccaacctcggtgggattaaggtgaaagtatgtggagttgtgcaatatgttaatctatttggtacagcaattggatatacaattgcatcagctataagtttggtagcaatccaaaggacaagttgccaacagatgaatggaccaaatgatccttgtcatgttaatggaaatgtttacatgattgcgtttggtattgtacaaatcatattctctcagattcctgattttgatcagttatggtggctttccattgtcgctgcggtcatgtcttttgcttattctgccattggacttggccttggtgtctctaaagtggtagagaacaaagaaattaaaggtagtctcactggagtcactgttgggacagtgacactgagtgggacagtgacatcgtcgcagaaaatatggagaacatttcagtctcttggcaacattgcgtttgcgtactcttactcgatgattctcatcgaaattcaggacacggtgaaatcaccgcctgccgaagtaaacacgatgagaaaagcgacttttgtaagtgtggcagtgactacagtcttctacatgctatgtggctgtgtagggtatgcagcatttggggataacgcacccggaaatctcctcgctcatggagggtttagaaacccatattggttgcttgacattgctaatctcgctatagtgatccatctagtcggtgcttaccaagtctattgccaacccctctttgccttcgtcgagaaggaagcctctaggaggtttccagagagcgaattcgtcacaaaagagatcaagatccaactcttcccggggaagccctttaacttgaatctcttcaggctcgtatggaggacgttcttcgtgatgacaacaacgttgatctcaatgttaatgcctttctttaacgatgtagtcggtctcttgggggccattggtttttggcctttaacggtttatttcccagtggaaatgtacattgcacagaagaatgttccgagatggggcacaaagtgggtttgtctacaagtcttgagtgtgacatgtctttttgtgtccgtagccgcggccgc

SEQ ID NO: 8422 - DNA, 990 bp, Arabidopsis thaliana
cttcctcactttgttcatcatcttcttctccgatctaaacaacaatggcgacaccaggagcttcctcagcaagagatgaattcgtatacatggcgaaactcgccgaacaagcagagcgttacgaagaaatggttgaattcatggagaaagtcgcgaaagctgttgacaaagacgaactcaccgtcgaagaacgtaatctcctctccgtcgcttacaaaaacgtcatcggagctcgtcgtgcttcgtggagaatcatttcatcgatcgaacaaaaggaggagtctcgcggtaacgatgaccacgtttcgttgatccgtgactacagaagcaaaatcgaaacggaactttctgatatctgtgacggaatccttaagcttctcgatacgattctcgttcccgctgctgcttctggagattcgaaggtgttttatctgaagatgaaaggtgattatcataggtacttggctgagttcaaatctggtcaagagaggaaagatgctgctgaacatactcttactgcttacaaagctgctcaggatattgctaattctgaattggctccaacgcatccgattcgtcttggtcttgcgttgaacttctctgtgttttactatgagattctcaattctccagatcgtgcttgtaatctcgctaagcaggcgtttgatgaagcaattgctgaattggatactcttggtgaagagtcatacaaggacagtactttgattatgcagcttcttcgtgataacctcactctctggacttctgatatgcaggacgatgttgctgatgacatcaaagaagcagcaccagcagcagcaaaacccgctgacgagcaacaatcctaagtcgtcttaccgcaactttgttgtcatttcagtatctaaaacctctccattaatatgtttttctcttggaggtgtttctctgttggtttcttatttccttttatccccaagctctctaaggcagtctaattcttgtcctttt

SEQ ID NO: 8423 - DNA, 1069 bp, Arabidopsis thaliana
gtgttggtacagcatatgttttgcccgaggaaaatgaaccaactaagggaaggatacttgtgtttatagttgaagaaggaagactgcagcttatcacagagaaggaaaccaagggagctgtttattctctcaatgccttcaatggcaaacttcttgcttctattaatcaaaagattcagttgtataagtggatgctgcgggatgatggcactcgcgagctgcaatctgaatgtggacatcacggtcacatactagctctctacgtgcagacccgtggagacttcatcgctgttggtgatctcatgaaatcaatctctttattgatctacaagcacgaggaaggtgcgatcgaggagagagctcgggactataatgcaaactggatgacggcagttgagatactcaatgatgacatctacctcggtactgataattgcttcaacatattcaccgtaaagaagaacaacgaaggtgctacagatgaagaacgtgctcgtatggaggtggttggtgagtatcacataggggaatttgtgaaccgattccgccatggctctcttgtcatgaagctgcctgattcagatattggtcagataccgacagtcatatttggcactgtcagtgggatgattggagtgatagcgtctctgcctcaagaacagtatgcgtttctagagaaactgcagacgagtctgaggaaagtgattaaaggagttggtggtctaagccacgagcagtggagatcgttcaacaacgagaaaagaactgcggaagcaaagggttacttggatggagaccttattgaatcgttcttggatttgagcagaggtaagatggaggagatctccaaaggtatggatgttcaagtggaagagttgtgcaagagagttgaagaactcactaggcttcactgaagcaaatccaagctctcctcttcccctttcgtttgttactttctcgacaatctttttggttttgaggagttgtcttttttcttttcttgatttgatagacaatttgtataacaatgcgattttgaggattatattaataagagtttcattgtgtg

SEQ ID NO: 8424 - DNA, 1048 bp, Arabidopsis thaliana
atccatccatcaccgatctctaatggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggtcaagagaggaaagatgctgctgaacatactctcaccgcttacaaagctgctcaggatattgctaatgctgaattggctccaacgcatccgattcgtcttggtttggctttgaatttctctgtgttttactatgagattcttaattctccagatcgtgcttgtaatctcgctaagcaggcgtttgatgaagccattgctgagttagatactcttggagaggagtcatacaaggatagtaccttgatcatgcagcttcttcgtgacaatcttactctctggacttctgacatgcaggacgaaagtccggaggagattaaagaagcagcagcaccaaagcctgctgaagaacagaaggagatctaagtttgtggtttcttttttcagtattcttaagttatgcaattataattatgtttctgcttggtgtttattttctaatctttcctttgctatccccgaagcttctaaggccgtctaattcttgtcctttgtttgcttttctcaatcgtggatgctactggatttctgttttgttttacttcttctcttgattgattgcatttcccggcttatgccttgtacttg

SEQ ID NO: 8425 - DNA, 1049 bp, Arabidopsis thaliana
aatccatccatcaccgatctctaatggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggtcaagagaggaaagatgctgctgaacatactctcaccgcttacaaagctgctcaggatattgctaatgctgaattggctccaacgcatccgattcgtcttggtttggctttgaatttctctgtgttttactatgagattcttaattctccagatcgtgcttgtaatctcgctaagcaggcgtttgatgaagccattgctgagttagatactcttggagaggagtcatacaaggatagtaccttgatcatgcagcttcttcgtgacaatcttactctctggacttctgacatgcaggacgaaagtccggaggagattaaagaagcagcagcaccaaagcctgctgaagaacagaaggagatctaagtttgtggtttcttttttcagtattcttaagttatgcaattataattatgtttctgcttggtgtttattttctaatctttcctttgctatccccgaagcttctaaggccgtctaattcttgtcctttgtttgcttttctcaatcgtggatgctactggatttctgttttgttttacttcttctcttgattgattgcatttcccggcttatgccttgtacttg

SEQ ID NO: 8426 - DNA, 535 bp, Arabidopsis thaliana
ctatctctcttcccaaatcacaaatggcgggtcgcggcaaaactctcggatctggcgttgctaagaaatcaacatcgagaagcagcaaagccggtctccaattccccgttggtcgtatcgctcgttttctaaagaacggcaagtacgcaacacgtgttggtgccggagctccggtttacttagccgccgttctcgaatacctcgccgctgaggtattggaattggctggaaacgcagctagggataacaagaagactaggattgtgccacgtcacattcagctcgcggtgagaaacgatgaggagctgagtaaactgcttggagatgtgacgattgctaatggaggtgtgatgcctaacattcacagtcttcttcttcccaagaaagctggtgcttcaaaaccttccgctgatgaagattagattagggatttgtgttgtggttgtttagctaattaatgtgtagcttagtctttcattagattagatctgaattagttttcattaatggtgttgtgtagtctctcttttgcttc

SEQ ID NO: 8427 - DNA, 1270 bp, Arabidopsis thaliana
ttccaaatttcactcttttcctctaaaacgcatttatcactttccctcattaaacacaaaaactcattcatcgtcctctctcgcttgacctacaacacccgattctctaatcgaaaccgtttctctctttttgatcagatctcagatctttccctctttgattcttcttccttagatcgattctctctagaaacaacaatggcgtctgggcgtgaagagttcgtatacatggctaagctcgcggagcaagcggagaggtacgaagagatggtagagtttatggagaaagtctccgccgccgttgatggcgatgaactcaccgtagaagagcgaaatcttctctccgtcgcttataagaatgtgattggtgctcgccgtgcctcgtggcgtatcatttcatcgatcgagcagaaggaagagagccgtggtaacgatgaccacgtcacggcgatccgtgaatataggtctaagatcgagacggaactctccggaatctgcgacggaatccttaagttgcttgactctagactcatccctgccgctgcttctggtgattccaaggtcttttaccttaagatgaagggagattatcacaggtacttggctgagtttaagactggtcaagagaggaaagacgccgccgaacatacactcgccgcttacaaatctgctcaggatattgctaatgcagagcttgctccaacacacccaattcgtcttggtcttgcattgaacttctctgtgttctattacgagatcctcaattctcctgatcgtgcctgtaacctcgccaaacaggcctttgatgaggcgattgcagagttggacactcttggtgaagagtcatacaaagacagtaccttgatcatgcagcttcttcgtgacaatctcactctctggacatctgatatgcaggatgatgctgcggatgagatcaaggaagcagcagcgccaaaaccgaccgaggaacagcagtgatcttttgagtgaaactgctagttttcttctagggtttggaatttcttctctttctcgtccatatgtttttcttaatccatctaagaggtcgctcttgccatttcgctcatcttcaaaagcttattcattcatcatatttgtggcaagtctgaaccatcaatcatctttttatctctttttaatttattttctcttttcttatttctttgttgttatcgatttcaatgtctgtgtaatcgaaacttgctttcttttctcatcaatttgaagatcataaagtctcttgtctctt

SEQ ID NO: 8428 - DNA, 1065 bp, Arabidopsis thaliana
cttattccattttttcaaaccacttgcaaaattcgaatcagatcttctcttcaatcgaaaaaaaagaaaggatttgctctagattgttgaatcgaagatgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggaaagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaaacccgaagaagaggaagagtcattttataatggtagaaaactttcatgtgataatctgagtgagggatagctcaggattcttataagagacacagttttattgttgtttgtttgttttgaaactacttgcgatttatcattcctcctttagcttcctcaatatttcctattctcctttctaatgaaatcaaaacttggtt

SEQ ID NO: 8429 - DNA, 1776 bp, Arabidopsis thaliana
ctatcatcacccatctccttagttctattttataattcctcttctttttgttcatagctttgtaattatagtcttatttctctttaaggctcaataagaggagatgggtgaaaccgctgccgccaataaccaccgtcaccaccaccatcacggccaccaggtctttgacgtggccagccacgatttcgtccctccacaaccggcttttaaatgcttcgatgatgatggccgcctcaaaagaactgggactgtttggaccgcgagcgctcatataataactgcggttatcggatccggcgttttgtcattggcgtgggcgattgcacagctcggatggatcgctggccctgctgtgatgctattgttctctcttgttactctttactcctccacacttcttagcgactgctacagaaccggcgatgcagtgtctggcaagagaaactacacttacatggatgccgttcgatcaattctcggtgggttcaagttcaagatttgtgggttgattcaatacttgaatctctttggtatcgcaattggatacacgatagcagcttccataagcatgatggcgatcaagagatccaactgcttccacaagagtggaggaaaagacccatgtcacatgtccagtaatccttacatgatcgtatttggtgtggcagagatcttgctctctcaggttcctgatttcgatcagatttggtggatctccattgttgcagctgttatgtccttcacttactctgccattggtctagctcttggaatcgttcaagttgcagcgaatggagttttcaaaggaagtctcactggaataagcatcggaacagtgactcaaacacagaagatatggagaaccttccaagcacttggagacattgcctttgcgtactcatactctgttgtcctaatcgagattcaggatactgtaagatccccaccggcggaatcgaaaacgatgaagaaagcaacaaaaatcagtattgccgtcacaactatcttctacatgctatgtggctcaatgggttatgccgcttttggagatgcagcaccgggaaacctcctcaccggttttggattctacaacccgttttggctccttgacatagctaacgccgccattgttgtccacctcgttggagcttaccaagtctttgctcagcccatctttgcctttattgaaaaatcagtcgcagagagatatccagacaatgacttcctcagcaaggaatttgaaatcagaatccccggatttaagtctccttacaaagtaaacgttttcaggatggtttacaggagtggctttgtcgttacaaccaccgtgatatcgatgctgatgccgttttttaacgacgtggtcgggatcttaggggcgttagggttttggcccttgacggtttattttccggtggagatgtatattaagcagaggaaggttgagaaatggagcacgagatgggtgtgtttacagatgcttagtgttgcttgtcttgtgatctcggtggtcgccggggttggatcaatcgccggagtgatgcttgatcttaaggtctataagccattcaagtctacatattgatgattatggaccatgaacaacagagagagttggtgtgtaaagtttaccatttcaaagaaaactccaaaaatgtgtatattgtatgttgttctcatttcgtatggtctcatctttgtaataaaatttaaaacttatgttataaattataaaaccgtgtgttttcaattctatatcaaattatagtagtttgt

SEQ ID NO: 8430 - DNA, 1093 bp, Arabidopsis thaliana
atacattgaacctttcctcttcttcttcttccttctaccttcttctctctgttcaattttgggggaaaatgggtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagagaacctccaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaatgcagcctccagaacaccgattcagacacaactttgcaattagggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctactaatgtttcctctttagcaagtatccgattgttttaaaagtaattttagagggatacttgcaaaaagaagagaagattcagttatctaatctctgcaccaactctctttgtccttcttcttttgattatttctcgactgtctctcctataaaaaagatatgcctagctgagagtttgaaatc

SEQ ID NO: 8431 - DNA, 927 bp, Zea mays
cttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagc

SEQ ID NO: 8432 - DNA, 1563 bp, Zea mays; identical to SEQ ID NO: 8357

SEQ ID NO: 8433 - DNA, 2372 bp, Zea mays
acctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacgatgacgagcagtacgtgtgggaatcccaggcgggcgggtcgttcactgttactcgtgacacgtctggggagcagcttggcaggggtactaagattacacttttcctcaaggaagatcagttagaataccttgaggagcgtcgcctcaaggatttggtcaagaagcactctgagttcatcagctaccccatctccctgtggaccgaaaagacaacggagaaggagatttctgatgatgaagatgaggaagagaagaaagacgctgaggagggaaaggttgaggatgttgacgaggagaaggaagagaaagaaaaaaagaaaaagaagatcaaggaggtttctcacgagtggtcattgatcaacaagcagaagcccatctggatgaggaagccagaagagatcacaaaggaagaatatgctgccttctacaaaagcttgacaaatgactgggaggagcatctggctgtgaagcacttctctgtggagggtcagctggagttcaaggctgttctctttgttcctaagagggccccgtttgatctcttcgacacaaggaagaagcaaaacaacatcaagctctatgtgcgcagggtgtttatcatggacaactgtgaggaactgatccctgagtggctgagttttgttaagggtattgttgactctgaggaccttcccctcaatatctcccgtgagactcttcagcagaacaagatcctgaaggtgatccggaagaaccttgtgaagaagtgtgttgagctcttctttgagattgctgaaaacaaggaggactacaacaagttttatgaggctttctccaagaacctcaagcttggcatccatgaggactcgcagaacaggggcaggattgctgagcttctgagataccactccacgaagagcggtgatgagctgaccagcctcaaggattatgtgacgaggatgaaggagggacagaacgacatctactatatcactggtgagagcaagaaggcagtggagaactcccctttcctggagaagctgaagaagaggggctacgaggtcctgtacatggttgatgccattgatgagtatgctgttggtcagctcaaggagtttgagggcaagaagcttgtctcggccaccaaggagggtctgaagcttgatgagaccgaggatgagaagaagaggaaggaggagctgaaggagaagtttgagggtctgtgcaagatcatcaaggaggttctgggcgacaaggttgagaaggttgtggtgtctgaccgtgttgtggactcaccgtgctgccttgtcactggtgagtatggctggacagccaacatggagaggatcatgaaggcgcaggccctgagggactctagcatgtcggggtacatgtcgagcaaaaagactatggaaatcaacccggagaacccaatcatggatgagctccgtaagcgcgccgaggctgacaagaatgacaagtcagtcaaggatcttgtgatgttgctgttcgagacagctctcctgacctccggcttcagcctggatgaccccaacacctttggcacccggatccatcgcatgctaaagctcggtctgagcatcgatgaggacgagtctgctgaggccgaagctgagatgcctccgctggaggatgacgccggcgaaagcaagatggaggaggtcgactaagcttcggatcactgtcgtttatccctaattacatatgataagctaaatcttgactactgtttgaggttttccgcacgttaacggttctcctgccggccaggcaatgagtttgttgtatagctatatggtactctgttttacagtttgttcttgttatctgtaatcctactagtatagtacatgttctac

SEQ ID NO: 8434 - DNA, 1336 bp, Zea mays
cgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaaagcaggcctttgatgaggcaatctccgagctagacagcctgggagaggagtcctacaaggacagcactctgatcatgcagctcctgcgtgacaacttgaccttatggacttccgacaccaacgaggacggcggggatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgcgtgcgctgaagctgcctgccattgccattgcctttgccgctgtttttaattaagcacacactctagatgttatgcccgcatgctatgtttcgattctcaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggtttaatgtctcggaataatatgaattggctgc

SEQ ID NO: 8435 - DNA, 1273 bp, Zea mays
gcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcctaaatctatggctcgtctcagtggtctagtatatgttttcttggttctctcttgattcctcacacggtgagtgggaccgttcgcatttgtctgtcccatcccatcttaacggtgaatgtgttttgtttggtgtct

SEQ ID NO: 8436 - DNA, 1204 bp, Zea mays
gcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaggatgtcctctccgttgccttctccgttgacaaccgccagatcgtctccgcgtcccgcgacaagaccattaagctctggaacaccctcggtgagtgcaagtacaccatcggaggtgacctcggtggcggcgagggccacaacgggtgggtctcctgcgtcaggttctccccaaacacatttcagcccaccattgtctccggttcctgggaccgcaccgtcaaggtctggaaccttacgaactgcaagctgcgctgcactctcgatggtcatggcggatatgttaacgccgtcgccgtgagccccgatggatcgctctgcgcctccggcgggaaggacggtgttactctgctgtgggatttggctgaggggaagaggctgtactcgctggatgcgggctccatcatccactccctctgcttctcgcccaaccgctactggctctgcgctgcgacccaggactctgttaagatctgggaccttgagtcgaagcacgtcgtgcaggacctcaagcctgacatccagatctccaagaaccagatcctgtactgcacaagcttgagctggagcgccgatggaagcaccctctacactggctacaccgatgggtctatcagggtctggaagatctctggatatggctacgcaggctagatgtcgaaatccagtcgagggtctaggaggtcttgttctgcgaaacattgcaatgcggaacatagttttttttatgtgagttacatcgtctgcttggtactttatggtcgcccaactatctaagcttagctttgttaatgaagtttatt

SEQ ID NO: 8437 - DNA, 989 bp, Zea mays
ggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggcgatgcaggcgagggacagtaatcttcggaggggggtgcaaagttgttcgagccccaatgttttagatgctctgtgctgtcgaagctgtgccgtgctattattgtagctgatttcgtctccattcacttcttttttcttgttagtaggctggtagtggtcgaattagtaccccattgctttgtgttgccgctagtccatgtggactggtattgttcccctggatttatttggcaagcgtgtccgtgctcgctctagcgttttattgagcttttaaagtcatcgcattcttatttgattgcaatcagttattggctgg

SEQ ID NO: 8438 - DNA, 1610 bp, Zea mays
ctcgctagctctgcatcatccgtcgttctggtgagcgagcgagcgagtgagagacctagctagactgaccggccgccggcaggccgagaacgaagcgcgtgtttgtgcatgagccatggcggaccagcagcagccacagcagcagccgcaggagatggacgttgatcgtaccggtggcctcgaactgcctccagggttccgcttccacccgagcgactttgagattgtcaacgactacctcacgaagaaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaagggcagggctcccaggggtgacaaaaccaactgggtgatgcacgagtacaggctcgaaggcagtggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgccatggacccggtggccccctactaccccaacccaaatgccggcgcggggatgatgccgcctatggcattggcaggtatgggtggcgccggcgggctccagatcaacggcgctctgttcggcaatccggtgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgagcaggctaatgccgccgagatctcgtcgatgatgtctgtgaccggcccagggtccgcgaccaccaccatagagatggatggcatatggaagtacaagtactgaaaaagtggatatggagtttggagacaaatgcatgaatatgcatgttatatctactatatctgcattgcattttgtgaaaatttgcatggttcctatatttctgcaataactagtcggtaagatatgtgtgcatgcatgtgctagtatatacatgcattgtatcattgcatgtgtggtatatgtgtgtgtcgtttggtcttagtaatccggggcatgatggtacccatacctggatttacatctgcttggtcgtgctgatgttgtgttgtaatttgtaaaaagcagattgaagttcggtacagtatattatcgtgaacct

SEQ ID NO: 8439 - DNA, 913 bp, Zea mays
cgaatatctcgagaatgatcctgttcccacttcccaccacagaaaagccagtccaagccaacataaaacaagcccgcccgtcattttcgtcacccctgacgctcgacgcctctcctcctctcctcccccacccgtccatcgccccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcagaaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctgccttcgtgccctgttttctaatgtaccgtggttgtgaaccggtcaatgtgatctgaaataaaacattgcgtgccaagtttgtgtt

SEQ ID NO: 8440 - DNA, 1125 bp, Zea mays
gccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatatt

SEQ ID NO: 8441 - DNA, 1763 bp, Zea mays
gcaggacaccactcatcttcttctcccccgcctcgtttccatcgccaccaccctcttctcctgcggtcctcccccgtcccactcccaccccctcgcctccgcctccactgcagctgccgccatgcagagcctcctcctgcccaccgctgccgtggccccggtggcggctccgtgcggaaggcggaatctcccgggacgcctctccgtccgcgcctccgcgacggcggtagcggcaccgcggcgggagacggatcccaagaagcgggtggtgatcacggggatggggctggtctccgttttcgggaacgatgtagacgcttactacgaccgcctgctagtcggggagagcggcatcgggctcatcgaccgcttcgacgcttctaagttccccacccgctttgccggtcagatccggggcttctcctccgagggatacatcgacggaaagaacgaccgccgccttgatgattgcctccgatactgcatcgtcagtggcaagaaggctctcgaggcctccgggatcgcccacggctccaagcccatggaaaagattgacaagacccgggccggtgtgcttgtgggcactggtatgggtggcctcacggtgttttctgatggtgtccagaatctcattgagaagggatacagaaagataactcctttcttcatcccatatgctatcacaaacatgggttctgccctgcttggaatggacattggttttatgggtccaaactactccatctcaactgcctgtgctacctcgaactactgtttctatgctgcagcaaaccatatccgtagaggcgaagctgatataatgatagctggtggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtcatggagagcctagagcatgcaatgaaacgtgatgcaccaataattgcggagtatttaggaggtgctgtgaactgtgatgcttaccatatgactgatccgagatctgatggtcttggtgtttcatcttgcatcaagcaaagtcttaaagatgctggtgtggcacctgaggaggtcaactatattaatgctcatgcaacatcaacccttgctggtgatctggcagaggtgaatgccatcaagcaagtcttcaaggacccatctgggatcaaaataaatgcaaccaagtccatgataggacattgccttggcgcagcaggcggtttggaagccattgctactattaaagcgataactactggatgggtgcatccaagcataaaccaatttaacccagaggaagcagttgaatttgacactgtacctaatgtaaaaaagcagcatgaagtgaatgttggtatctcaaattcctttggatttggaggtcacaattctgtcgtagtatttgcaccatttaagccataaggtgttccttgcctcacaaatcttggtcagaacagtgagatctgatttctgcgttcaattttcatgtgttctcttcggggtgaagtaatgtcagatttgaaccagcaacgttaaaaatgaactaaagatgagatacattgcgttttagatgactccatgttcacttagattgagcgcggctgtacaacattcctttgaatcatttgtaattgattgtactgtttttcatgtaatggaagaggagtcttgtagatgc

SEQ ID NO: 8442 - DNA, 2637 bp, Zea mays
ccagtccctgtacctccgtataaaccctagtacctcttatccgttcgtcactccccaagcgtcacaccgaatcaccacagtcgagctcgagcaggaacaagccgtgagcgcctgcccccggtgctcaatatctattccacacctcatggcgccggcgctgagcaggaccctggggccgtcgtcggtggccgcgctgcgcccgagcccgtcgtgccggggtctgttacgggccgcgctcgcgccgcagggcaggggcgcctccgcgaggtgcgcggtaggggtgagatgggaggcagccaggcggaggaggatggccggggtgaggtgcgacgccgccgtcgctgagaagcctgccggcgaggaggagacggccggcgagaagtacgagtaccaggctgaggttacccgcttgatggacttaattgtacacagtttatacagccacaaggaagtatttttacgtgagcttgtaagtaacgcgagtgatgcactggataagctgagattcctcagcgtaactgatccttctgtgttggctgatggcggtgagttggagataaggattaaacccgacctagaggcggggacaatcactatcacagatactggcattggaatgactaaagatgagctcaaagactgtcttggaaccattgcacaaagtggcacctcaaagtttttgaaggctctaaaggagaacaaagaccttggtgcagataatggactcattggtcaattcggtgttgggttctattccgctttccttgttgcagagagggttgtggtgtctactaaaagtccaaaggcagataagcagtatgtgtgggaagcagaggctgacagcagctcgtatgttatcaaggaagaaaatgatcctgagaaaatgctttcacgtggaacagaaattactctttatttgagagatgatgacaaatatgagtttgctgaccctaccaggattcaaggcttagttaagaactactcgcagtttgtctcattccccatatatacatggcaggaaaaatcaagaacagttgaggttgaagaggaggaagaatcaaaaggtgaagaggctactgaagaatcaaaaagtgaagaggctactgagggtgaaaagcagaaaaagaagaaaaccataactgagaagtactgggactgggaattggctaatgaaacgaagcccatatggatgaggaatccaaaggaagttgagaaaactgagtacaatgaattctacaagaagacatttaatgagtttctggatccgcttgcttacactcacttcaccactgagggagaggtggaatttcggagtgttctctatgtcccagggatggcgcctcttagtaatgaggagataatgaatccaaagaccaaaaacatccgattgtatgtcaaaagagtgttcatatcagatgattttgatggcgagctgtttcccagatacttgagctttgtgaaaggtgtagttgactcaaatgatctccctctcaatgtttctcgtgagatccttcaagaaagtagaattgtcagaattatgcgtaagagacttgttaggaagacatttgacatgattcaagagattgccgagaaggatggcaaagaggactacaacaaattctgggagagctttggcaagttcatgaagcttggttgcatcgaggacacaggaaaccacaagcgtcttgcaccattgctgagattctactcttccaaaaacgagacagatttaataagtctggaccagtatgtagaaaacatgcctgaaaaccagaaggcgatctattatatcgctactgatagtctccagagcgcgaagactgctcctttcttggaaaagctggttcagaaagatattgaggttctttacctcattgagccaattgatgaggttgccattcagaatttacagacatacaaagagaagaagtttgtagatattagcaaagaggatttggaattgggtgatgaagatgaggacaaggagaaagaaagcaagcaggagtatactcttctatgcgactggataaagcagcagcttggcgataaagtcgccaaggtccagatctcgaagcgactcagctcttctccatgtgttcttgtttctggtaaatttggctggtcagccaacatggaaaggctcatgaaggcacagacccttggtgacacatcaagcctggagttcatgagaggtagacgaatttttgagatcaaccctgaccatcctatcatcaaggacctgaacgctgcttgcaaaaacgagcctgaaagtactgaagccaagagggcggcagagttgctatacgaggctgcgctgatctccagtgggtatactcctgacagtccagcggagctgggaggcaagatctacgagatgatgaccatggccctcggcgggagatgggggaggttggagacagaggaggctgaagtcatcgccagcatcgacgacgcggactcgtctgaaggtgccacgaccacgacagaggtagtcgagccctctgaggtcaggacagagagcgacccgtggaaggattagatagttctgtatgcaaggattatgccctggtggtgtatgagcaccggatgtaacgaaagtacgaaccagagccaggatagagaaatacagcgtttgat

SEQ ID NO: 8443 - DNA, 1726 bp, Zea mays
ccagaaaccgtgtgctccccgaagcagtttagatatcttcctcccaaccttccctgccaaatcgcggtcactgctccgaagtccgaaccttcatacacatcgtctcgtttccgatttccccaaattcaggccacaggcgctacaggacccaggcaccactcggtcggcggccaccgcgtcgccccgcctgctcgattggggtcgcgtgtgcgataggaagtattgtgttgtgtttgcaacgtgatagcttgtactgggaacaaaggtcaagatgggcgccttggacctacaccttgactttgcttctgctcaacatggacaagccaagttaaaggaatatgccaagagctctttgttgtctgatggaaactacaatacagacaagatcaatggttcaaaccctgatgactatgagaaatttgagaaagggataatgcactatgggtgtccacattatagaaggagatgccgcataagagctccttgctgcaatgaaatttttgattgccgacactgccacaatgaaactaagaattccattaaaattgataaaatgaagaggcatgaacttccacgccatgaagtgcagcaggttgtatgctcattgtgtggcactgaacaggaggtgcgacaagtatgtatcaattgcggtgtttgcatggggaaatacttctgtggtttgtgcaaactcttcgacgatgatgtctctaaacagcagtatcactgcaacggatgtggaatatgtagaatcggagggagggagaatttcttccactgttcaaaatgtggatgttgctattcaattgcgctgaagaatagtcatgcatgtgttgaaggggcgatgcatcatgactgtccaatctgcttcgagtacttgttcgattcgacaaatgatgtttccgtcctgccttgtggtcataccattcatgtaaagtgcctgaaagaaatggaagagcactgccagtttgcatgccccctttgctccaagtcggtttgtgacatgtcgaaggcatgggaaaggctcgacatggagctggcaactctgtctgactcctgtgatcacaaaatggtccgcatattatgcaacgactgcggggcaatatcagatgtgcagttccatttgattgcgcacaagtgccagaattgcaagtcatacaacacccgccagatttgaagtaagaatcgcaagtcacacaacaccgtcagatctgaaatagcaaatcctgtgggggtttctgcatttcttcaagaagcgtgatggactgatggccccttcccgtgagctgctgagcaccgggatatctggcaagacactcatcactgtatccactccactgggtcctgcggaggcaaacagctcgagattgtatatctgctgctagctgccgcccttcgttatgcataagcctactcttgccgttttactcctgtcgctccgtgattctagtgtaataatgtcatatttactgttgcttcaagtatggcccgtacggctgcggttgaacggcggcggcggctgctgagccacagtaccttgctgttgctgagactgcacccagccacagtgcgccgccgccgccgcagcttgtagctggacttgatttatgaaggtgccggaagagttcttggttgcgggtagctattaaggccatctcgagtagatgtcctattacatcccttatttcatcctctatttcaaactttatataaatagtattaaatatct

SEQ ID NO: 8444 - DNA, 2786 bp, Zea mays
gcccaacccttcctgacgctccacgcgctcgtctctctccttccttccatcctccctccctccttccctccctcgctcgcctctggaggaccctcgccatcctgcccaagcgcaccaccaaacccccagcagcggcgctagggttcgcgcctcggcgcgtcggcaccgtcacctgcggcgatggcggggcaggagcgtaggacaatcgatctggaggagggatgggcgttcatgcagaagggcatcaccaagctgaagaacatcctcgagggcaagcccgagccgcagttcagttccgaggactacatgatgctctacacgacgatatacaacatgtgcacgcagaagccgccgcaggactactcacagcagctctacgacaagtatcgggagtcgttcgaggagtacatcgcctccatggtactaccttcattaagggagaaacatgacgagtttatgctgagggagctagtgcaaaggtggtcaaaccataaagtcatggttcgctggctgtcacgcttcttttattaccttgaccgatacttcatatcaaggaggtcacttacaccacttaaagaagtgggccttacttgcttccgagagttgatctatcaagagattaaaggacaagttaaagatgcagtgatagctctgatagacaaagaacgtgagggtgaacagattgaccgggctctgttgaagaatgttttggatatttttgttgaaattgggttgggtcaaatggagtgttatgagaatgactttgaagatttcttgctcaaggatactacagagtactactctgtcaaagctcaaagctggattcttgaggactcatgcccagattacatgattaaggctgaggagtgtttaaagcgggagaaggagcgagttggtcactatttgcatattagcagcgaacagaagttattggagaaagtgcaaaatgaattgcttgctcagtatgcaaccccgctgttagagaaggagcattctggatgttctgctttgcttcgcgatgacaaggttgaggatctttctaggatgtacagactcttctccaaaatctcccgtggtctggagcctatttcaaacatgttcaaaacgcatgtcacaagtgagggtacagccttggtcaagcaagcagaagattctgctagtaataagaagccagagaagaaggatatggttggcatgcaggaacaggtctttgtgtggaaaatcatcgagctgcatgacaaatatgtagcttatgtgacagaatgtttccagggacatacactcttccataaggcacttaaagaagcctttgaggtcttctgtaacaaaggtgtctctggcagttcgaatgctgagttgttggctaccttctgcgacaatattctgaagaaaggctgcagtgaaaagctcagtgatgaagccattgaagatgcccttgagaaggttgtgagattgctggcatacatcagtgataaagacctgtttgccgagttctataggaagaaacttgccagaagattacttttcgacaaaagtgctaatgatgagcatgagagaagtattctgacaaagctcaagcaacagtgcggggggcagtttacttccaaaatggagggcatggttacggaccttactgtcgctagagatcaccaaactaagtttgaagagtttgtagctgggcatccagagttgaatcctggcatagatttggctgttactgttttgacaacgggattctggccaagctacaaaacttttgacataaaccttcctgcggagatggtgaaatgtgtagaggttttcaaggaattctatcaaacaagaacgaagcacaggaagctgacatggatttattccttgggaacctgcaacatcaatgctaagtttgatgctaaacctattgagctcattgttacgacatatcaggctgcattactactactgttcaatggatccgaaaggcttagttattctgaaattgcaacacaattaaacctgtcagatgatgatgtagtgcgtttgctccattcactttcttgtgcaaaatacaagatccttaacaaggaaccagcaaatagatccatctcgcccaatgatgtttttgagttcaattcaaaatttactgacagaatgagaagaattaagattccactgcctcccgttgatgagaagaaaaaggttgttgaagatgttgacaaagacaggaggtatgcaattgatgcatcaattgtgcgcattatgaagagccgcaaagttatgggtcatcaacagctggttgctgaatgtgttgagcagcttagccgcatgtttaagccggacttcaaagccataaagaagaggattgaggatctcatcacaagggactatttggagcgcgacaaggacaacgccaatacgtacaaataccttgcctgattggtggttagtgacaaagtccaaaacagctccgggactatgcgataccactgggatggcaatcttcctgcaatgtcgtggtgcgtccacttctaccatgatttgcagcacgttttggtgatttgccctgccacagcacgggctgctcgcattttgtacattggtcgttaaataggataagcgtgttggcctacattagatataatgatgattgatgatgaggaataggagaggcattcaagtacttgtatgtgtcttctatgccaatgctttatctatatagctgtatcagtgttccagtcaattgatatgagatgatgcttggagtcgttttgctatatgaagtgacggatacaatgggaatttgcagc

SEQ ID NO: 8445 - DNA, 1545 bp, Zea mays
cttccgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacatatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctc

SEQ ID NO: 8446 - DNA, 2216 bp, Zea mays
tggaaggtcgtctcgacatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcagaccttgtgaacaaccttggtaccattgcacgatctggcacaaaagagttcatggaggcactggctgctggtgccgacgtgtccatgattggtcagtttggtgtcggtttctactcggcataccttgttgctgagagggttgtcgtgaccaccaagcacaacgatgatgagcagtatgtatgggagtctcaggccggtggctccttcactgtcacacgtgatacctctggggagcaacttggcaggggtacaaagatgaccctttacctcaaggatgatcagttagagtatcttgaggagcgccggctgaaggatctgatcaagaagcactcagagttcatcagctacccaatctctctctggatcgagaagaccactgagaaggaaatatctgatgatgaggacgaggaagataagaaggacgaggagggcaaggttgaggatgttgatgagaaggaagaaaaggaaaagaagaagaagaagatcaaggaggtttctcatgagtggcaattggttaacaagcagaagcctatctggatgagaaagcctgaggagattaccaaagaagagtatgctgctttctacaagagcttgaccaacgactgggaggagcatctcgccgttaagcacttctctgttgagggtcagcttgagttcaaggctgtcctgtttgtgccgaagagggccccctttgacctcttcgacaccaggaagaaactgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctatgaggccttctcgaagaacctgaagcttggcatccacgaggactccacgaacaggaacaagattgcggagctgctgaggtatcactccaccaagagcggagatgagctgacaagcctcaaggactatgtgactaggatgaaggagggccagaatgacatctactacatcactggcgagagcaagaaggccgtggagaactcccccttccttgagaagctgaagaagaagggctatgaagtcctgtacatggtggacgccatcgacgagtatgctattggccagctcaaggagttcgagggcaagaagctcgtctcggccaccaaggagggcctgaagctcgatgagagtgaggatgagaagaagcggaaggaggagcttaaggagaagttcgagggcctgtgcaaggtgatcaaggaggtgctgggcgacaaggtggagaaggttgtggtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggacaacgccatcatggaggagctgcgcaagcgcgcggaggccgacaagaacgacaagtctgtcaaggaccttgtcatgcttctgttcgagacggcgctgctcacctcgggcttcagccttgacgaccccaacaccttcggcggccgcatccaccgcatgctcaagctgggcctcagcatcgacgaggacgaggctccggaggccgacaccgacatgcctcctctggaggatgacgctggcgagagcaagatggaggaggtcgactagtctggctatcgtgtcttaattggtgtgtgcgtgtttttttttacttttgctagcctgcaaacttcgtacgtttattattgtcggtataatagtgctccggctgcc

SEQ ID NO: 8447 - DNA, 1788 bp, Zea mays
ccctcactctcgttccatttccccatctcccagatccaattcgcgagttcttcctcctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgt

SEQ ID NO: 8448 - DNA, 1592 bp, Zea mays
ggcgaggcaaaagcattgcgaccacagacagcgcgcgcttcaaggccttttttttttgagataacaaggaggagaggaggagatggcggtcacgatcacgtgggtgaaggcgaggcagatcttcgacagccgcggcaaccccaccgtcgaggtggacgtgggccttagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaatgttggggatgaaggtggttttgcacctaacattcaggaaaacaaagaaggccttgaactattgaaggcagccatagaaaaggctggctacactggaaaggtggtcattggaatggatgttgctgcttctgagttcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagatccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaactgtttttttttc

SEQ ID NO: 8449 - DNA, 1460 bp, Zea mays
aaccgaactcgcacctcgcacctcgcatcgtcttgtcgacacacctccagctccgaaaccctactccgccggcgatgtcgtcatccggcgccccggccccggcggcggcaatggccgttgacgacgcggaggacgaccagctcgcctccatgtccacggaggatatcatccgggcctcccgccttcttgacaacgagatccgtgtcctcaaggacgagttgcagcggacgaacctggagttggagtcgttcaaggagaagattaaggaaaaccaagagaaaattaagctcaacaagcagctgccctacctcgttggcaacatcgttgagatcttggaaatgaaccctgaggatgaagctgaggaggatggtgctaacattgatttagactcacaaaggaaaggaaaatgtgttgttctgaagacctccacaagacaaactatattccttcctgttgttgggctagtggaccctgacaagctaaagcctggtgatctggttggagtcaataaagatagctaccttatactagatacattgccatcagagtacgattcacgagtgaaggcaatggaagtggatgaaaagcccactgaagattataatgacattgggggtcttgaaaagcagattcaagagcttgtagaggcaattgtactgcccatgacacataaagaccggttccagaagttgggtattcgtcctccaaaaggggttcttttgtacggaccaccaggaactggcaagacactcatggctcgtgcatgtgctgcacagacgaatgcaacgtttcttaaattagctggtccacaacttgtgcagatgtttattggtgatggagcaaagcttgtccgggatgcattccagcttgccaaagagaaagctccttgtattatatttattgatgagatagatgccattggcaccaaacgttttgatagtgaagttagcggtgatagagaagttcagcggacaatgttggaattattgaatcaactggatggattcagcagcgatgagagaataaaggtcatagctgcaactaaccgtgctgacatccttgaccctgctctgatgcgatctggacggttggaccgaaagattgagttccctcacccatccgaagaagcaagagctagaatcttgcaaatccattcaaggaaaatgaatgtaaatcctgatgtcaactttgaagaattggctcgctcaactgatgacttcaacggagcacagctaaaggcagtttgtgtagaagctggtatgcttgccctacggcgggatgctacagaggtaactcacgaggatttcaatgaagggatcgtacaggtccaggcgaagaaaaagtcaagcttgaactactatgcttaagctgtttgtcaaaacatatggaccataaggtgtttgtaacactactgtatgaataatcgaagctatgtttttaatgcaagatttttacagcat

SEQ ID NO: 8450 - DNA, 1262 bp, Zea mays
caactggaggccaatagaatcgctcgcttgcgttatcttgttcgcctcgtcagttgttgtttcctcccttcccatcccccactgctcagcagtcagtcagcactcgccacccacacgcctccgctccgcccacggttccactccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagt

SEQ ID NO: 8451 - DNA, 2003 bp, Zea mays
cccaagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgagctcaagcccgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccctccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatttcaagggcactgacaagaaaaggaacagctctggtcaaacttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaacgagttcttcaaggagcaaaaatacccagaagcaataaaacactacacggaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccgtggaaacctaccaggctggcttgaagcatgacccgaacaaccaggaactgcttgatggtgttaagaggtgtgttgaacagatcaacaaggccaacagaggtgaaataagccaggacgaattgcaagaaagacagaacaaagctatgcaagacccagagatccagaacattcttaccgaccctatcatgcgacaggttctaatagatttccaggagaacccaagtgcggcccaggagcacctgaagaaccccggggttatgcagaagattcagaagcttgtaagtgctgggatagttcagatgagatgatcgagcgatgcgatgattggctttgtttgttcacgtgcaccctggtcatacatatgttttaacaagcagcagcggcataagaatgaacctgttcgggggctaatcttatcccatttggattgtaagtgcattgacattggataattcatgtttgtggcactgagtttcgagt

SEQ ID NO: 8452 - DNA, 1289 bp, Zea mays
ctccaagaaaccaccgccgagcccaaccgcacaagcgcgcgaggcaggagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggcatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacatcatcatgcaatgcctgggtgccatctgtggagctggagtggtgaagggcttccagcagggactttacatgggcaacggtggtggcgccaatgttgtcgcacctggctacaccaagggtgatggccttggcgctgagattgttggcaccttcatcctagtctacaccgtcttctcagccaccgatgccaagaggaatgccagggactcccatgttcctatccttgccccactgccaattgggttcgcggtgttcctggtccaccttgccaccatccccattactggcactggcatcaacccagctaggagccttggcgctgccatcatctacaacagggatcacgcctggaacgaccattggatcttctgggtcggccccttcattggcgctgctctggctgccatctaccaccaggtgatcatcagagccatcccgttcaagagcaggtcttaagctgccgtggccgtgccgagacatgccagtccgaagaacgggcgtcttcctgtgatgtcttcttgtctgcccacgcctagtttctctgtcgattcctattcgtcgtctcttcagggctggtgctcactgctgcgccgttctgttaaccgaaacaagaactctgtgtattcctgtaccgagctgtgcatgttttttttttctttccatcgtggagaatttaagttattatccgtttgctgcaaggtttgccgtctcattttatgcgttgggatgttggcaagaaagggcagatgtcatgtgagaatttaagttaagtgaaatcgattcagggttttcttggtttc

SEQ ID NO: 8453 - DNA, 2346 bp, Zea mays
gcagaatcaatagctgcactagcgcgtattgacactgtgaaacagcgcatggaagccgcatacacaacattgcaggatgctgctgggttagctcagttgagccagagtgttgaggatgtgttttctagtggcaatcttccaaaagctgcagaaaccctggcaactatgagacattgcttgtcagcagttggagaggttgccgagtttgcaaacgtcagaaaacaacttgaagtattggaagaaaggctagatgaaatggtgcagcctcgattagtagatgcactttctaatcgcaaggttgatgccgtgcaagatcttcgtggtatactgatccgtatcaataggttcaagtcactggaagtgcaatacactaagatccatgttaagcctctaaagaaactctgggatgattttgagctaaagcaaagatccagcaaggtagacatggagaaactcagtggtgaaagcattagtggcctctcattctctagttggctgcctaatttctatgatgagacactgctttaccttgaacaagagtggaagtggtgcttgactgctttccctgacgaatacaaatcacttgtaccaaaagtacttactgagaccatgagtgagttgaattcaagctttgtctctcgtataaatatagcaaccggggatgttattcctgaaaccagatctattgccaaaggtatattggatgttctatcaggtgacttaccaaaaagcaccaaattgcagaataagcatcttcaagcgctaattgaactgcacaatatgactggcacttttgctaggaacattcagtacttattttcagaatcagatcttgcagttgtgctgaatactttgaaagctatttattctccatatgaaacctttaaagcaaggtatgggcagatggagcgtgctatactctctgctgagatgacaagtatcgacatccgtggggccgtccctcgtggtgttggtgcacagggtatagagctgagcgaaactgtccgcagaatggaggaatccatcccagaaatgatagtactccttgaggcagctgtggagagatgcattagtctgactggtggttcagaagcagatgaactggtactggctcttgatgacgtcatgctgcagtacatatctaatctccaagaaacattgaagtccctgaggataatctgtggactggatagtgatgccttgaaaaaagatgcaggtttagagaaaaaggaagtacaacgattggtggatgtttctgaagaggaagaatggtctattgtccaaggtgctttgcaaattcttacagttgctgattgcctaactagcagaacctcagtctttgaagcttctttaagagctacacttgccaggattggaacaaacttttctgtttctggatttggctcaagcctggataaatcacctgcagcaactgctgatgagaatgcagacttgtcttttgctgggagggctgcgctggacattgcagctattcgcttaagtgatctgccagataagtctaagaagttcttaactgtgctagaacagtcaaaagatccaagattccatgctcttcctctcacatcacaaagagttgcagccttctcagacacagtaaatgaactcgtctatgatgtgctcatatctaaggttcggcagcgtctcagtgaggtcgcacgccttccaatctggtcatccgtggaggaacagggtggtcttcctcttccaagcttcagtgcctacccgcaagcatacgtgaccagcgttggggagtatctcctcactttaccacagcagctggagccactcgcggaaggtatctcaggcaatgaggctggcaacgatgaggcccagttctttgccaccgagtggatttttaaggtcgccgaaggtgccactgctttgttcatggagcagctccgaggaatccactacatcaccgaccgaggttcacagcagctcgctgctgacattgagtacctaaacaatgtcctctctgcgctctcgatgccaatccctccattcctgtctaccttccacgcctgcgtctccaccccgagggaccaggtccgtgatctgatcaaatctgatggtgcaagccagctcgacctccctactacccatctggtctgcaagatccggcggatcacattagattagtgaaatcgtcctaacttctccccctttccatgaggtttacctctgtaaaagcatgcattaccgcacgcttctgcgatcgtatgtttggcatgcgggcttgtagcttgttgcttcaccttttttttcttgccttgtaaccgtactgctggcacatagtgagaataatcctatatagaataattcatt

SEQ ID NO: 8454 - DNA, 2571 bp, Zea mays
caactccctccatcgtcttgaggcgtgcgcagccatggctgtcctcggcaccgcggcggttgaggtgctcatcccggtagcggcattggttggcatcgctttcgcgttgttgcagtggtatgtggtggccagagtccccgtgccttcgcacgccggcgaggacggcggtggaggaggcaataagaacgtgagggaggaggaggagcatgtggaggaggacggcatggactaccttctcgtggaggcccggtgcgccgagatccagcgcgccatctccgtcggcgccacgtcgttcctgctaaccgagtacaagtacctggccgtgttcacggcggcgttcgcggtggtgatcttcgtgttcctgggttcggcgcagcggttcagcgcgcgccctgggccgtgcgcgtacgacccgtcgcgggagtgccggccggcgctggcgaacgcggccttcagcgcggtggcgttcctgctgggcgcggcgacgtccgtgctgtccgggtacctcggcatgcgcgtggcgacgttcgcgaacgcgcggacggcgctggaggcccgccacggcgtggggcgcgccttcgccgccgcgttccggtcgggcgccgccatggggttcctcctcgcctccagcgcgctgctcgtgctctacgccgccgtcaacctcttcggcctctactacggcgacgactggggcgggctctacgagtccatcaccggatacggcctcggcgggtcctccgtcgcgctgttcggtcgcgtgggcggcggcatctacaccaaggccgctgacgtcggcgccgacctcgtcgggaaggtcgagcgcaacatccccgaggacgaccctcgcaaccccgcggtgatcgccgacaacgtgggggacaacgtcggcgacatcgccgggatggggtcggacctgttcgggtcgtacgcggagtcgtcctgcgcggcgctcttcgtggcttccatctcctccttcggggcggagcacaacctcacggcgatgatgtacccgctgctcatcagcgccgtgggcctgctcgtgtgcgcgatcaccactgtcgtcgccaccgacgtcaccgaggtgaagggttccgacgaggttgggccggcgctcaagcggcagatcctcatctccaccgtgcttatgaccgccggcatcgccgccgtcaccttcctcggcctgccgcccagcttcaccctcttcgacttcggcaacgacaagcacgtcaagaactggcacctattcatctgcgtgtcggccggtctgtgggcggggctcgtgatcggctacgtcaccgagtacttcacgagcaacgcgtacggcccggtgcaggcggtggcgcggtcgtgcaggacgggcgcggcgacgaacgtcatcttcggcctggcggtgggttacaagtcggtgatcgtgcccatcatggccatcgcggcggccatctacgccagcttccgcctggcggccatgtacggcatcgcgctggcggcgctggggatgctgagcaccatcgccacggggctcgccatcgacgcctacgggcccatcagcgacaacgccggcggcatcgcggagatggccggcatgccgcaccgggtccgggagcggacggacgcgctcgacgccgcgggcaacaccacggccgccatcggcaaaggcttcgccatcggctccgcggcgctggtgtcgctggcgctgttcggcgcgtacgtcagccgcgccgggatcacggcggtggacgtgctgagcccgcgtgtgttcgtgggactcctcctcggcgccatgctcccctactggttctcggcgatgaccatgcggagcgtcggaagcgcggcgctgaggatggtggaggaggtgcgccgccagttcgacaccatcccgggcctcgccgagggcctcgccgtgccggactacgccacctgcgtcaggatctccaccgacgcctcgctcaagaagatgatggcgccgggcgcgctcgtcatgttcagcccgctcgtcgccggtacgctcttcggggtcgagacgctcgcggggctcctcgccggcgcactcgtctccggcgtccaggtcgccatctctgcctccaacagcgggggtgcatgggacaacgccaagaagtacatcgaggccggcttgtcggaggaggcgaggtcgctggggcccaagggatcggaggcgcacaaagcggcggtgatcggggacaccatcggcgacccgctcaaggacacctccggaccgtccctcaacatcctcatcaagcttatggccgtggagtcgctcgtcttcgcgcccttcttcgccgcgcacggtggcatcatcttcgaccacctctgatcaatgcatgctgctgacgttccatggcaaaggcgccggctgtcgccgcaagccgcctctttgaatttgccgtgatcagttagtaagaataatcgtcgtgtatgtagcctgtaacaagtaatgccagaccaccagagttggaggcttattcatgtctggccctcttatcttacccttgaatatgttgctcggtatgctgcaactgcaatacaaagcgcgaacactagtcggctaaaaaa

SEQ ID NO: 8455 - DNA, 1487 bp, Zea mays
ggtccaacagcggcacagcccacgggccacgcccagttgatatccctgatggcctgatgtcgcaactcgcaaccctagctcccagcctcccactcccacgcgcttcaagtcttcccaggcggccggcggcgtactcccagagtcccagacggccaatcttcccagcatcgggtggcgtcctcactccaggcggcaggcggctgcaccgccgcagtcacgaactcacgcgcaccgcgggcccgcggcagcgcgcacacgcgcacacgcgcacggcgcaccagcagccgtgagccggccagtccggcagtcccagcctcccaggcggccagtcctcccagtcccagtcccagctgcctaggtctgccgcctgtcttgaccccacccactggccacttcccctcctgtccgttcccaaatcccgtcccctccacccgcactccattggcgccgctcccctcccctcgccgccgccggagatctgatccgatccgtttgtgcttgtgctggacgatggtgggcctctctgaaggggagaaacacttcatccgcggcggcattgcacaagacgttcgcactgatggacgtaggcggctgcagttccggtccctctccgtccaaaccggagtcattccacaggcgaatggctcagcgcgtgttaggttgggggccactgaaataatcgctagtgtcaaggctgaactaggaaaaccaagcattcttcaccctgacaaaggaaaagttgctatttttgtcgactgtagtccaaccgctgagcctctgtttgagggtagaggctctgaagaattgtctgctgagctctctgtttccctgcaaagatgcttgttgggtggtaaaagcggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagttcgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaacactctatatttacaaagtcattttgctctct

SEQ ID NO: 8456 - DNA, 1396 bp, Zea mays
cttccttccttccccgccactgcgcagcgcgagtgcggcgacagccagtcacacactcccactccctcgaccgctctcggccctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaggaaacgttccttgcttgcaccctcggctggtgcattgaatggcttcaggctttctttcttgtgcttgatgatatcatggatgactctcacactcgtcgcggccagccttgctggttcagggtgcctcaggttggcttaattgctgcgaatgacgggatcatccttcgcaaccatatctcacggatccttcggtgccactttaagggcaaaccttactatgctgatctccttgatttgttcaatgaggttgagttcaagacagcttcaggtcagcttctggaccttatcactacccatgagggagaaaaagatctaacaaagtataacataacagttcacggtcgaattgttcaatacaagacagcctattattcattttatctgccggttgcatgtgccctgctgctctctggcgagaatttggacaattatggtgatgtagagaacatccttgttgaaatgggaacatactttcaagtccaggatgactatctggattgttatggtgatcctgaatttatcggcaagattggaacggacattgaagattacaagtgctcatggctagttgtgcaagcccttgagcgtgctgatgagagccaaaagcgcattctatttgaaaattatggcaagaaagatccagcctgtgtggcaaaagtgaagaacctctacaaagaacttgacctagaggcggtatttcaggagtacgagaatgagagctacaagaagctgattgcagacattgaagcccagccaagcattgcggttcagaaagtgctgaaatccttcttgcacaagatctacaagaggcagaagtagggtgctcttggataaacgagctcaggagtcgttaccccttcgcatgcttgacataacgggacttcctcacctggttcctctagtatgatgtggagcgtctagttaaaaaaaatggatgtagtatgaagcaccttgctgctctgaatattaacaggcaattaaggcaaggtgctgtttcggtttggtggaccgcatgttgcagataataaattagttgttttgtc

SEQ ID NO: 8457 - DNA, 1185 bp, Zea mays
acagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggacatgttttttctgagttctacacctgcttgtcttgcttatgtgacggtggagtattgtgcctttaatatcaacctaatc

SEQ ID NO: 8458 - DNA, 1150 bp, Zea mays
cggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaccttttccatcgctgtttattgtgagtggtcctatatc

SEQ ID NO: 8459 - DNA, 1612 bp, Zea mays
ctcgctagctctgcatcatccgtcgttctggtgagcgagcgagcgagtgagagacctagctagactgaccggccgccggcaggccgagaacgaagcgcgtgtttgtgcatgagccatggcggaccagcagcagccacagcagcagccgcaggagatggacgttgatcgtaccggtggcctcgaactgcctccagggttccgcttccacccgagcgactttgagattgtcaacgactacctcacgaagaaggtgcacgacagggactacagctgcatcgccatcgcggacgccgacctaaacaagaccgagccatgggacctcccgaaagttgcaaagatgggcgagaaggagtggtacttcttctaccagaaggaccgcaagtacccgacggggctgagggcgaaccgggccactgaggcgggttattggaaggcgaccggcaaggacaaggaggtctacgatccccttgcagcggaagggctgctgctggtcggcatgaagaagacgctcgtgttctacaagggcagggctcccaggggtgacaaaaccaactgggtgatgcacgagtacaggctcgaaggcagtggtaggctccctgctagtcctgcatccgcatccggctcagccaccaacatcgctgcggccatgatgaaagcttcagcttcggcttgcaaggatgagtgggtggtctgtcgtgtgttcaacaagaccaccgggatcaagaagacggctgcgccggcataccaggtggccatggccggtgctgagatggatcagaatcagaacaacattccggccatccccatccccatgccgctgcagctgccactgcccgtgcccatgcagatgcaatttcccatcctgccagattttgccatggacccggtggccccctactaccccaacccaaatgccggcgcggggatgatgccgcctatggcattggcaggtatgggtggcgccggcgggctccagatcaacggcgctctgttcggcaatccggtgcccgcgccgctgccgatgaacttctaccaccaccagatgggcatgggggcagcagctggccaggtggacatgggggcagcggctggccagatggacatgggagcagctggcgctggcgctggcggcttcgacgttgcagcgccggagagtaggccgtcctcgatggtgtcacagaaggacgagcaggctaatgccgccgagatctcgtcgatgatgtctgtgaccggcccagggtccgcgaccaccaccatagagatggatggcatatggaagtacaagtactgaaaaagtggatatggagtttggagacaaatgcatgaatatgcatgttatatctactatatctgcattgcattttgtgaaaatttgcatggttcctatatttctgcaataactagtcggtaagatatgtgtgcatgcatgtgctagtatatacatgcattgtatcattgcatgtgtggtatatgtgtgtgtcgtttggtcttagtaatccggggcatgatggtacccatacctggatttacatctgcttggtcgtgctgatgttgtgttgtaatttgtaaaaagcagattgaagttcggtacagtatattatcgtgaacctat

SEQ ID NO: 8460 - DNA, 1151 bp, Zea mays
ggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggatttctctgttgagccagctgatgagaggaggcctttccgtgctctcttggatgttggccttattaggactacaactgggaaccgtgtctttggtgccctcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagtcgaac

SEQ ID NO: 8461 - DNA, 770 bp, Zea mays
ctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggccttaccgcttcagccgtgccagatgccaatgatgatgccaggtatgatgccaccgatgacaatgatgccgatgccgaatatgatgccatcgatgatggtgccgactatgatgtcaccaataacgatagctagtatgatgccaccgatgatgatgccaaacatggtttcaccaatgatgatgccgagtatgatgccttcgacgatgacgccgagtatgatgccaccgataatgatgccaagtatgataccaccgatgatgatgccgagcatggtgtcatcaatgataatgccaaacatgatgacagtgccacaatgttactctgattccatctcgcacattatacaacaacaacaattaccattcatgttcagccccacagccatggcgatctcacccatgtttttacagcagccctttgttggtgctgcattctagatataagcatttgtgttgtacccaataatgaagtcggcatgccatcgcatgcgactcattgtttaggaataaaacaagctaataatgacttttctctcattataatgt

SEQ ID NO: 8462 - DNA, 831 bp, Zea mays
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagaaaaaaaatggtgcttcttggtgctgc

SEQ ID NO: 8463 - DNA, 748 bp, Zea mays
caatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcggggaggagtcgggtttgttgggaaggaaaattagattagtatcagtttttttgaatgggatgggaacgtggctgtgaatctcagggttgtatgctcgttgagaaagaaatggaaggacttcgtgatgcacgatgttgatgccgcatcatattcagcgtagaactgcatttcttctgagcggcaatggtgtcaccgaaaaatggaagtatttggctggtgtcggc

SEQ ID NO: 8464 - DNA, 2336 bp, Glycine max
agagcatgaaatcttctgcgaggaaaagggtgtcaattatcaggaactcaaatcctggccaagatattgctgaacttcaacctgcatccccaggaagccctcttttggttcctaggcaaaagtattgtgaatcattgcacaaacccatcaggagaaaaacaagcacagtaatggttggtaacgtggctattggtagcgagcatcctataagaattcagaccatgactacaactgacactaaggatgttgctgggacagttgaacaggtgatgagaatagcagataaaggagctgatattgtacggataacagttcaagggaagaaagaagctgatgcttgttttgagattaaaaacacccttgtgcagaaaaattacaacataccgttggtggctgatattcattttgctccctctgttgctttgcgggtagctgaatgctttgataagattcgtgtaaaccctggaaattttgctgatagacgggctcaatttgaaacattagagtacacagaagaagactatcagaaagaacttgagcatattgaaaaggttttcacaccattggttgagaaatgtaagaaatatgggagagcaatgcgcattgggacaaaccatggaagtctttctgatcgtataatgagctactatggagattcacctaggggaatggtagaatctgcttttgaatttgcaaggatatgccgaaagttggactatcacaattttgttttttctatgaaagcaagcaacccggttatcatggttcaggcataccgcttacttgtggctgaaatgtatgtccaaggctgggattatccattacacttgggtgttactgaagctggagaaggtgaggatgggaggatgaagtctgcaattggcattggaactcttcttcaggatggattgggtgatacaattagggtttctctcacagaaccaccagaagaggagatagatccttgcagaaggttggcaaatcttggaatgagagcttctgaactccagaagggggtggaaccttttgaagaaaagcacagacattattttgacttccagcgccgatctggtcaattgccagtgcaaaaagagggtgaggaggtggattacagaggtgcactgcaccgtgacggttctgttctcatgtcagtctccttggatcagttaaagatgccagaggtcctctacaagtcacttgctgccaaactcattgttggcatgccatttaaggatttggcaacagtagattcaattttattacgggaacttcctccagtagatgatgctgatgctcgactagcactcaagagactgatagatatcagcatgggggttataactcctttgacagagcagctaacaaagccattacccaatgccatggttctagtaaaccttaaggaaatatctaccggagcttataagcttttgccacaaggaacacgcttggttgtgtctgtccgaggtgatgagccttatgaagaactggacattcttaagggtgttgatgctactatgcttctccatgaccttccttatacagaagacagaattagcagagtgcatgcagccagacggttatttgagtacctatctgacaattctctaaacttccctgttattcaccatattcagttcccaaatgggattcacagggatgacttggtaattggtgctggttctgatgctggagcccttctggttgatgggcttggagatggactacttttggaagccccggacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccctggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagagcatggacgatgggtggaccctcctgcagaggagtaaaggcaagagctcaattttgagattggcattcaagtccaatgtaagatgatcattgttatagcctattattgtacacatgtaaagtaagcactgaatgcttaagtttgagcatagttttaagttaaggatcacaattaaagcttgggcggtgaggaaatcgacagctataacaagtatacagacaacatcaataataataataataataatgat

SEQ ID NO: 8465 - DNA, 1502 bp, Glycine max
attatattatccgattcagaattgtgtggactggaaactcctctgtccccaaacaggacgatgaaggaactgggcttggtttcaatgatgctgatggcagagttgttggacgtgatcgtcaacactctaagcaaagcagccatgaagaagggcatgaatgactttgtattcatcatgtactccaatgccttcgctgcatgcctcctccttctcttagccttattcttttataggaaaagaacacttccgccactctcctgtaacacccttggcctattccttgttgttggcatgctcagttgcattaatcagtcgatcaagtttttcggcataggttacagctctccaactttggcctcagcactgtccgatttggtgcccgcctttaccttcatacttgccgtcatcttcaggatggaaaaattagattggaaagctaatagcactctggccaagtccattggcacagtggtatcgatcgctggggcattgttattgtctttgtacaaaggccaagtcatcataaataataatccaccttttaaattgttccctcaaaaacttgtctcatccatgcaatttgactgggtatttggggcactgttgcttgcagctcatagctgttttctctcaataaactacattcttctgacacggatagtgagagaataccctgcagaactggtggtggtactcagtcgcattgcattaacatctatactatctgttcctgctgcactgatttcagtaaaggatctaaaagctttgagactggggtttaatatggagcttatagctattggatgttcagcaatttttgtcttatcctttcgaggtgttatccatatatggatcatggggaagaggggccctgtctatgttgcaatgtttaagccactcgaaattgtcttcgcagtcatcttgggggttacttttcttggggactctctttatattggaagtgtgatcggagctgccataatagttgttggtttttatgctgttatttgggggaaaagtcaagagaaggtggaggaagattgtacagtctgcagctctgagtcatatgataatgaggtccctcttttacagaacaagagaacgggggaataaaatcttcaggaaatgatttatatactttctgcttgtaagcaaagaacgatggcagaaaaatttcaatattcttgtttcctctaaatctgtttccctgggcctgcaagaaatagatattggtcaccgaggacatgaatagaaagattgcataatttgcacaagatattgattttttgggtgccacttattccctacatccaccgagaagggtcagagcggattacaattttctgccattgctgagttgaatgcacacaaatatcaatcagtttgacctttccttctttatttggttcttgtggactttcggatttcacctccagttgttgtatagatcgtctaccaatattatggaatgtgctgtgaaataattaattttagttcttaac

SEQ ID NO: 8466 - DNA, 1482 bp, Glycine max
acctttgcaaaccctttccaacaattagcaaaacatttgttaaacgatggaagtaatgtgtggtgccaaagttggcaatatggtccataaggccaagccttatgtgttaactgtggggttgcaatttgggatggctgggacatacctcttcaccatggccagtttgaaccatggaatgagccgtttggtgttcattgtgtatcgcaatgccattgctgcattggcccttgctccctttgccttgatctttgaaaggaaagttagaccaaagatgacatggactgtcttcatacagatattagtacttggatttcttgagccagtggttgaccaaggattcactttcttggggatgcaatacacttcagcttcctttgcatccgctgttatgaatgccgtgccctctgtaacctttgtgcttgcagtaattttcaggttagagcatataaaaataagggaattacgcagtcaagcgaaagtaattggaaccttagtaacctttgctggggctttgttaatgacactatacaaaggccctcaattcgacctatttcatcattcaaacacaacccaccaacaaggtggaagccacactcagaatcactcacactgggtcgcaggaactctcttcatttgcctgggttgcctggcttggtcttccttctacatattgcagtccataacggtgaaaaggtaccctgcggaactatcactctcatcgttgatatgcttggcgggtgctttgcaaagtgccgtggttgctctgattgcagatcataaccctcgagcatgggctatcggttttgactacagcctctacggtcctctatacactggaataatgagttcaggaatagcatattatatacaagggttggtaatgcaaagcagaggtccagtgtttgtaacatctttcaatcctctttgcatgatcattgttacagctttgggctccttccttctaggagaacacctctacttgggaagcatcattggaggcatcataatcgcagtgggtctatactctgtggtgtggggaaaaggcaaagactataaagatgacacgtcatcaccagcaacaacaaaagaaacagaaacaatgcagcttccaattaccttaccaaataataaataacagacactttgtgttaacttatagaaaagaaaaattacatagtaattcgatcgacttatgttggcggaagtgaccgatgatagcgtaatttgcaaatcatatagtgatttgttgtgctggtgtgggcactatatttagccatgttaagttgaaacacgactttgtttaagttaatactaatttgttagaaagtgttttgctatcgttaattattccaagagtttaaattgttaatcaatgtgtaattttattttcttcctgcttttgtattttttttatcatgatatatgatatattagtgcggaatatttatcacgatgaaatcagatagctggtttaataaaacc

SEQ ID NO: 8467 - DNA, 1569 bp, Glycine max
acactacccactcaactcactccaaccatggcgtcgtggtggtgctcctctccctccgccaccctcaccgtctccaccaccaccacccgccacttctctctcctttctcacacttcccaatttcgcatccaaaccctcacattcccaccttcctcctttactcgcttcaccaccgctccaccttcgctccgatttagggttccatgctccaacaaaaccgccttcgaaaccgagcttccggaggacggcgtggattgcgtgggaacaggccaagacgtggaatgcctcgttaacacggaagagaaacaatcggaaccatcatcatcgtcatcatcatcatcatcatcgtcatcgatgctgtgtctcgcggaagcgctgtgggaaggggcggtgttggtgtcgccgttcttcttctggggcacggccatggtggcgatgaaggaagtgcttcccaaatgcggtcctttcttcgtttccgcttttcgcctcattccggcggggtttcttctcgtcgcattcgccgcttccagaggaagaactctcccctctggcttcaacgcttggctttccatcaccctcttcgctctcgtcgatgccgcgtgctttcagggttttcttgcagaagggttgcaaaggacttcagctggtttgggcagcgttataattgattcgcagcctttgactgtggctgtacttgcggctttgttatttggtgagtcaatcggagttgttggagctgctgggcttgtacttggtgtcataggacttgtactgctcgagttacctgccctatcatttgatgaaagcaacttctcactatggggaagtggtgagtggtggatgctacttgcagctcagagtatggcaattggcacggtcatggtccggtgggtctccaagtactctgaccctgtcatggctactggatggcatatggttattggtggtctcccacttgtgctattcgcagttcttaacaatgaccccgcagtgagtttgagtctcaaagagtacagttcgactgatatattggcactcctctacacatccatttttggaagcgcagtcagctatggtgtgttcttttatagtgcaactaaaggtagcttgaccaagctcagttcacttacgtttttgaccccaatgtttgcttcaatttttgggtttctctatcttggtgagaccttctctcctgtacaactagttggggccttagtcactgtggctggaatatacatggttaacttcagaagcacatctgaatgaattgtcatttttgcctggttctttcaacctaatccaatggaaaacaactctgggaattagatgttttccatgaactcaaattgggaacgataaaagcaagtttggacatggagaggagaaattgcagtgatatacaacttggagcccttgtgctcatgctagtgtaaatacaattttgttttgttagttaatttaggcctcgagcctcttcctatgcaatatataccaaaaacttgaagttacctgggcagaacacaagccttatatcggaataaattgtttccgtaaaggtttttttgttgt

SEQ ID NO: 8468 - DNA, 1623 bp, Glycine max
cgcaaacgcaactcagctttccttcgatccctgaatctggacgttactaaagcagcccagccatccacgcaccattttaaaagccaacacagaaagcacagaaccaccacatcgttgccttcctctaaacgataaatttttgggattctgaaactagtgatacattttcttgcatgaaggcagcgtattgaggaattcagttagtgtattggaagatctagttcaacatgtcttctgtaagcaagggtgataggaaggcttccattgatgcagcatcatggctgttcaatgtggtcacgtctgtgggaattattcttgtcaataaggccttgatggctacatatggttttagttttgctacaactttaactggtctccattttgccacgacaaccttgttgacactcattcttaaatcgttgggatatatccagacctctcatcttccattatctgatataatcaaatttgtcttgtttgcaaatttctccattgttgggatgaatgtgagtttaatgtggaactctgttggtttctatcagattgctaagctgagcatgattccagtatcttgcttcctggaggttgtcttggacaatgtacgatattcaagggacacaaagcttagtattgttttggttttgctcggcgttgctgtctgtacagtcactgatgtcagtgtcaatgcaaagggtttcatagctgctgtaatagcagtttggagcacagccctgcaacagtattacgtgcattttcttcagaggaagtattctattgggtcatttaacttgttgggccatactgcaccagcacaggcagcaagtttacttctagtaggcccctttatggactactggttgactggcaaacgagttgatgcctacggctatggtttgacatccacgttgttcatcattctgtcttgcactatcgcagtagggacaaacctcagccagttcatctgcattggtaggttcacggctgtaacgttccaagtccttggtcacatgaagactatcctggtcctgatcttaggattcattttctttggaaaagagggtctcaatctacatgttgttctaggcatgatcatcgcaatagcaggaatggtttggtatggcagtgcttcttccaagccaggggggaaagagcgtcgtagcttttccctccccaaaacacaagattatagttcactacctgtgtcctctgaaccagatacgaaggaatagaaaataatagaaactaattagagaaaaagtgatgaaacttctggtgaactgcatgaaaaaaatcaggtgcccattaggcgagctggttcattttctttataccaggagtgaattcccaattatttatagatcatggttatatcttttcttatgtgttaatgaattgtttgggaaagaaatgagaggaaacagcgttaagggatggaaaaatctacgttatgttcctttttttttatgacagaaaatgttactgttacttttatagtaaaagtttaattccatttttcccattagggttggttccgttgttaccttctactcatgacaactattagcatgtttggattacctagttatgaaatgttttactctataaaatacttttgaaagtttt

SEQ ID NO: 8469 - DNA, 1968 bp, Glycine max
gaattcggcccgaggtagctgaatgctttgataagattcgtgtaaaccctggaaattttgctgatagacgggctcaatttgaaacattagagtacacagaagaagactatcagaaagaacttgagcatattgaaaaggttttcacaccattggttgagaaatgtaagaaatatgggagagcaatgcgcattgggacaaaccatggaagtctttctgatcgtataatgagctactatggagactcgcctaggggaatggtagaatctgcttttgaatttgcaaggatatgccgaaagttagactatcacaattttgttttttctatgaaagcaagcaacccagttatcatggttcaggcataccgcttacttgtggctgaaatgtatgtccaaggctgggattatccattacacttgggtgttactgaagctggagaaggtgaggatgggaggatgaagtctgcaataggcattggaactcttcttcaggatggattgggtgatacaattagggtttctctcacagaaccaccagaggaggagatagacccttgcagaaggttggcaaatcttggaatgatagcttctgaactccagaagggggtggaaccttttgaagaaaagcacagacattattttgactttcagcgccgatctggtcaattgccagtgcaaaaagagggtgaggaggtggattacagaggtgtactgcaccgtgatggttctgttctcatgtcagtctccttggatcaattaaagatgccagaggtcctctacaagtcacttgctgccaaactcattgttggcatgccatttaaggatctggcaactgtagattcaattttattacgggaagttcctcctgtagatgatgctgatgctcgactagcactcaagagactgatagatattagcatgggggttataactcctttgtcagaacagctaacaaagccattacccaatgccatggttctagtaaaccttaaggaaatatcttccagagcttataagcttttgccacaaggcacacgcttggttgtgtctgtacgaggtgatgagccttatgaagaactggacattcttaaaggcattgatgctactatgcttctccatgaccttccttatacagaagacaaaattagcagagtgcatgcggccaggcggttatttgagtacctatccgacaattctctaaacttccctgttattcaccatattcagttcccaaatgggattcacagagatgacttggtaattggtgctggttctgatgctggagcccttctggtggatgggcttggagatggacttcttttggaagcgccagacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccccggtgtttcgattgcaatcatgggatgcattgtaaatggaccagggagatggctgatgcagactttgggtatgtgggaggcactcccgggaagattgacctctatgttgggaagactgtggtgaagcgtggaattgcaatggagcatgcaaccaatgccttgatcgatctaataaaagaacatggacgatgggtggaccctcctgccgaggagtaaaagcaagagcttaattttgagattggcattcaaggccatagtaagatgagcattgtcatatccaattattgtacacatgtaatataagataacactcaatgcttaagtttgagcctagttttaagttccttttgagaaagatcccaattaaagcttgttgtgaggaaatcgacagctagaacatgtatacagataacagtgtattgctttgccccatcagccatcaataataatgagaatctcttagaatagtgccagtt

SEQ ID NO: 8470 - DNA, 2329 bp, Glycine max
aggaactcaaatcctggccaagatattgctgaacttcaacctgcatccccaggaagccctcttttggttcctaggcaaaagtattgtgaatcattacacaaaactgtcaggagaaaaacaaacacagtgatggttggtaacgtggctattggtagcgagcatcctataagaattcagaccatgactacgactgacactaaggatgttgctgggacagttgaacaggtgatgagaatagcagataaaggagctgatattgtacggataacagttcaagggaagaaagaagctgatgcttgttttgagattaaaaacacccttgttcagaaaaattacaacataccgttggtggctgatattcattttgctccctctgttgctttgcgggtagctgaatgctttgataagattcgtgtaaaccctggaaattttgctgatagacgggctcaatttgaaacattagagtacacagaagaagactatcagaaagaacttgagcatattgaaaaggttttcacaccattggttgagaaatgtaagaaatatgggagagcaatgcgcattgggacaaaccatggaagtctttctgatcgtataatgagctactatggagactcgcctaggggaatggtagaatctgcttttgaatttgcaaggatatgccgaaagttagactatcacaattttgttttttctatgaaagcaagcaacccagttatcatggttcaggcataccgcttacttgtggctgaaatgtatgtccaaggctgggattatccattacacttgggtgttactgaagctggagaaggtgaggatgggaggatgaagtctgcaataggcattggaactcttcttcaggatggattgggtgatacaattagggtttctctcacagaaccaccagaggaggagatagacccttgcagaaggttggcaaatcttggaatgatagcttctgaactccagaagggggtggaaccttttgaagaaaagcacagacattattttgactttcagcgccgatctggtcaattgccagtgcaaaaagagggtgaggaggtggattacagaggtgtactgcaccgtgatggttctgttctcatgtcagtctccttggatcaattaaagatgccagaggtcctctacaagtcacttgctgccaaactcattgttggcatgccatttaaggatctggcaactgtagattcaattttattacgggaagttcctcctgtagatgatgctgatgctcgactagcactcaagagactgatagatattagcatgggggttataactcctttgtcagaacagctaacaaagccattacccaatgccatggttctagtaaaccttaaggaaatatcttccagagcttataagcttttgccacaaggcacacgcttggttgtgtctgtacgaggtgatgagccttatgaagaactggacattcttaaaggcattgatgctactatgcttctccatgaccttccttatacagaagacaaaattagcagagtgcatgcggccaggcggttatttgagtacctatccgacaattctctaaacttccctgttattcaccatattcagttcccaaatgggattcacagagatgacttggtaattggtgctggttctgatgctggagcccttctggtggatgggcttggagatggacttcttttggaagcgccagacaaggattttgaatttattagaaacacttctttcaatttgttgcaaggctgcagaatgagaaatacaaagacagagtatgtctcatgtccatcctgtggcagaacattgtttgatcttcaagaagtaagtgcacaaattcgggagaagacatcacacctccccggtgtttcgattgcaatcatgggatgcattgtaaatggaccaggggagatggctgatgcagactttgggtatgtgggaggcactcccgggaagattgacctctatgttgggaagactgtggtgaagcgtggaattgcaatggagcatgcaaccaatgccttgatcgatctaataaaagaacatggacgatgggtggaccctcctgccgaggagtaaaagcaagagcttaattttgagattggcattcaaggccatagtaagatgagcattgtcatatccaattattgtacacatgtaatataagataacactcaatgcttaagtttgagcctagttttaagttccttttgagaaagatcccaattaaagcttgttgtgaggaaatcgacagctagaacatgtatacagataacagtgtattgctttgccccatcagccatcaataataatgagaatctcttag

SEQ ID NO: 8471 - DNA, 1730 bp, Glycine max
gtttgatatcctgattcctactctcttagtttccactctattgtatggatgcatgtgatgaactgatgatatatgcatttgcttttatagtttgcttggccaccaagtaacgacaaagagaaacagtttctaactttttcttggctggttgtaaataatctctcttttctctattggatcatagctttctgcaccctcttcctcttaggttcccatatttttctctcttgtcgtggacctcaactttgtaggctcgccttagaaaaaaccttcttttctttttggtgggggtgagagttgctatcttattcctggtttcatcaacaagacactaacatctttgttgtttttagtttcagaattccttatactcacacaccaaaattctggtacaccatgatttttccaagattttgtacgaatctaaaaggtatggcttttatagattctcaagtttatcttgatcacacaggtaaaagattctgaaaatctgtgcaccttgtgaatcaaagctctataatttcttcctttccgtgtatctcttctgtgttttttgtgagcagccttttctagttcctctccatttccatctctttaggaacttaattcaactaagattttttgtgtgcttgtggcttgaggtatggaattggaaaccctctacaccccttgttatatgccaaactcaaattggtttgtgcaagagagcctcagcacagagtggactagagaagataacaagaagtttgaaagtgcccttgctatatatgacaaggacaccccagatagatggttcaaggtggccgctatgatccctgggaagactgtgtttgatgtgatcaagcaatatagggaactggaagaagatgtgagtgaaatcgaagcagggcatgttccgattcccggctaccttgcatcttctttcacctttgagctggttgacaaccacaactatgatggatgcagaagaaggcttgcacctgtcagaggctctgatcaagagagaaagaaaggagtcccatggactgaagaggaacacagacgttttctgatgggacttttgaagtatggtaaaggagattggagaaatatctctcgcaattttgtggtcacaaagactccaacccaagttgctagccatgcacaaaagtactacataaggcaaaaggtttctggaggcaaagataaaaggagacctagcatccatgatataaccactgttaatcttacagaaacttctgcatcagacaagaacaagcctcctgtgattgcaccacagcagaagctgaatagcatgtcaaaagtacagctggactggactagtagccactacaatgatggatcactcatggttttcaacccaaatagtgatgacttgtttgtgtcatcttcatctgatgtcacttccatggccctgaaaatgcaagggcaagatctctatgaatgtgccttacgtgaggcttatgccaaggtaaaagttccaggtttcagcatggctcctagagacttcaataatgaagctgtttttggtattcatgcactgtaattccaaccctgatgatgttaaagaaaaaattatagatcattgttctgtaggattaatgtagatgacctgaagctagcaagctacttcgttcatcattagtgaacatcctaaaagaaaactagactaatgtttcaatccttaaaaactgaatttggaatggacttcttttaaagttttcctcttt

SEQ ID NO: 8472 - DNA, 1411 bp, Glycine max
actccgcaatgctgatttccattctctcttagtgtcagtcttattcctcccgaacccgaaattcagtccttaaatgataaataatatcccagttgtttctgctaaacttgggggagtaggaaaacatggccactttcgagcaattttggagcagaaaaacgttactaggtcttgctttgggacagtttctttctctcctcatcacttccactggtttcacctcttctctattggctaaaaaaggaattaatgcaccaacttctcagtcgtttctaaactatgtgttcttggcaattgtctatgggattattgttctatacagaagggaagcactcaaggcaaaatggtattattacatacttcttggattggttgatgttgaagcaaattttcttgttgtgaaggcatatcaatatacatcactaacaagtgtgatgctgcttgactgctggtccatcccatgtgtcatgctttttacatggattttcttaaaaacaaaatatggattcaaaaaggtcactggtgtagttgtttgcattgctggccttgtcctggttgtattttcagatgtccatgcaggcgaccgggcagggggaagcaaccctagtataggggacattcttgttattgctggtgctacattgtatgctgtcagtaacgtcagcgaggagtttctagtgaaaaatgctgatagagttgagttgatggcaatgttgggactctttggtggcattattagtgccattcaaataagcatacttgagcgcaatgagctcaaatctattcactggtcagctggggcagttcttccttttgttggatttgcggtggctatgtttatgttttactctttagtccctgtcctacttaagatcaatggttccactatgttaaatctgtctctattgacctctgacatgtgggctgtcttaattcgcatttttgcttaccatgagaaggttgattggatgtactatgtggcctttggtgctgttgttgttggtctcattatctactctggtggtgacggagatgagaatcaagaccctcatcatgttgctgaagatgctagccaaagacaacatgatgaagaagctacttcaggtaaatcataatataacagcagccaggctggaagctcaaaacactaagcacgcctgaagaggtgcttgaaaggtaaaaccatgacagagtctcctccaaagatgaagattttacttccattcaatttgtgtagatggaattttgagtgttttggacggttttttgaaagttggtactagatttttagtgaacatagtttgctaaatatgatatttaattatttttgaagaaaatctataagaaagattttcggagataataagtaacagccgtttattttttcgtatgaaatttgggatgttcgatt

SEQ ID NO: 8473 - DNA, 1377 bp, Glycine max
gtctctttgtagatcaagagtggttcctccactcactttttccatcctatccaaaattgcccttcttggagtgatagggtgttcatctcagatcttggggtatgctggcatcaggtatagttctcccacactttcctctgcaatcagcaacctcactcctgctttcaccttcgtgcttgcagtcatttgcaggcacattcttgttttgttttttcttgtcctattaccaccacaaattaaggatggaaaagatagctgtaaaacgtagaacaacccaagctaagatattgggcagcataatatcagtattaggtgcatttgttgtgactttctacaaaggccaatcggtcatcatagctgataattccccttccattcaacttccacaatcaaatggcattcttacttcagtggatagaaattgggtcattggtggccttctgctcacagcttgcaatatactacttactgtatggttcgtttaccaggttgaaatcttgaaggagttcccggatgaactatctatggtcttcttttacaacttgtgtgcagccattgtagcatcaattgtaggcttattaggggagaaaaattcaagtgcatggaaaataagaccagatatatcactgatctctattgtttgcactgtaatatacccctgaatttttttcttcactttcacctaaaaaatacacttgagttaatacaacttgctgatgatgcatttttttaaattagggaatatttaacaagttcctgagtagtgcaatatatgcttggggaatacacttaaaagggcctgtgtatgtagcaatgttcaagcctctctcaattgttattgcggttgccatgggtgttatgttccttggtgattctctatatgttggaagtataattggagccacaataatatcaattgggttttatactgttatgtggggcaaagcaactgaacagaaggaagaggagggggaggaggaaaatgttggtagccaggaatcatcaattactgagaacgttcctcttttgcaaagctatataactgtaaattctacgaagaaaatagatggaagtgtatagacagctgaaatgagaagtttcctcttctgcaaaaccaaaaaatttgtaaattctgaatagaagacaggtggaagtgtatagaagacaaatataaactgtttgcacctctttagtcttgacattgtagaaaatcatagagaccattttttgtcacagaacagcacattgtaactttcagtaatttatgaaaatacaattctcccatacttactataggttctagttgcagaagcagcctagacaatgggagcatcatgtacctttatacttcagatacaatagtcaatatttctaagg

SEQ ID NO: 8474 - DNA, 1537 bp, Glycine max
cggaaagatcaggctttgctttgctttgtgtgagatctgaagaagagaggtatggcaaaaagggtcttcttgtacaaggatttggttccttttggggccatggtgaccatggaatgcctcaacgtagccttgaatactctgttcaaagcagctaccttgagagggatgagttaccatgtctttgttgtttatgcttatgctgttgctgctattgttctcattcctggaccctttatctcccaaaggtgcagatcaagagtgcttcctccgctcagtttccccctactacgcaaaattggtcttctcgggctaatagggtgtgcttctcagatcgtgggatacacaggcatcagtttcagttcccccactctctcctcggcgataagcaacttggtgcccgcttttacttttttgcttgccatcattttcaggatggaaaaggtgattgtaagaaatacaacttgtcaagccaaggtattgggtaccatagtatcaataactggagcattcgtagtgaccttctacaaaggaccaccaatcatcattgttcatacaccttccttgtcacttcatcaaccaattaacactctgaattcggtagatcgaagttgggcaattggtggccttctactgacagcagagtatattctggttccattatggtacattgtacaggtgcaaatcatgaaggtgtaccccaatgaactaactgtgatcttcttttacaatttatgtgtaagcatcatggctgcaattgtagctatatttacagagacaaatgcaggagcttggaaaataggactagatacagcattggcttcaatagtttgctctggaatttttggttcatttgtgaacaacgcagttcacacatgggtactacgtataaagggtcctgtctatgtggcaatgttcaagccactctcaattgccatagctgttgccttgggagtcatgttcctgggtgatacactccaccttggaagtctagtgggagccacagtaatatcgatcggattttatacagtaatgtggggaaaagcaaccgaagagaatgtggacgaagatgtccctggccagcaatcaccaccaaccacagagaatgttcctctcttgcaaagctataaaactgatacagctgaaaagaaaatgcatggaagtgtataaatgacaaacaaaactgttgataaatcttaacattattgaaattacacgaatagcaaagcaaatacatggttttgttttcgcccaagctaaccctgtaacgccaatagcaattagcaaagtaggtacccacgcctttagagtgtagaggacatcatatgtaagaaatagttcaagggttcaactgatctcctttcgccaaggaacataaacgaatctttatacaaattagggagcaacctatctacaagtttgtgtacgaacactcacagatgaaaacggagcaacttcgttatctgtcttcccttttcctgtctcttgtaacaagtcatccatattatgatttatagaagctgcgtgattctttaacatt

SEQ ID NO: 8475 - DNA, 1409 bp, Glycine max
gagaagaagagagagacagacagaacaatgggggaagcaaagggaaaggaagaagaagtgttagccccagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaatgcgttgtggacaccatctaagttaatagctcgattgggaaaagaaataaaaaatgaaagctcttacctttactgggcatacaagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgggactctgctcagactgttaaggtacactgtgatgcaacaatagcatttcctctgctggttgctgaaacgtttgcttcaagagtgaaacctccccattgatgaaggttaaagatgaatttactctgaagttcattttaattgtgtgtgtttgaggatcttgatggacaagttcggcattggtgttcaatttgactatcatttgattcctaagctcctcttagcagtggagacctttttgaccattcaaaggtaatccattaatcctgtcagtgaggaagtcaggaattatagatgtgaggatcattgtactaatatctttagggaaaataaggctaagaaaactaactgatcatatatggcatttttaatattttcccc

SEQ ID NO: 8476 - DNA, 1409 bp, Glycine max
gagaagaagagagagacagacagaacaatgggggaagcaaagggaaaggaagaagaagtgttagccccagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaatgcgttgtggacaccatctaagttaatagctcgattgggaaaagaaataaaaaatgaaagctcttacctttactgggcatacaagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgggactctgctcagactgttaaggtacactgtgatgcaacaatagcatttcctctgctggttgctgaaacgtttgcttcaagagtgaaacctccccattgatgaaggttaaagatgaatttactctgaagttcattttaattgtgtgtgtttgaggatcttgatggacaagttcggcattggtgttcaatttgactatcatttgattcctaagctcctcttagcagtggagacctttttgaccattcaaaggtaatccattaatcctgtcagtgaggaagtcaggaattatagatgtgaggatcattgtactaatatctttagggaaaataaggctaagaaaactaactgatcatatatggcatttttaatattttccac

SEQ ID NO: 8477 - DNA, 708 bp, Glycine max
gtccggaaatcgttcctatcatcacttctcaaatctcgaaccctctcgttcgtgccgatcactaggtcacacttcatcaatggcgggtagaggcaaaaccctaggatccagcgccgctaagaaggccacctcaaggagcagcaaagccggcctccaattccccgtcggtcgtatcgccaggttcctcaaggccggaaagtacgccgagcgcgtcggcgccggagcccccgtctacctcgccgccgttctcgaatatctcgctgctgaggttttggaattggctggaaacgctgcgagagataacaagaagactcgaattgttccacgccacatccaattggcggtgaggaacgacgaagagttgagcaagcttctaggagatgttaccattgctaacggcggtgttatgcctaacattcacaaccttcttcttcccaagaaggctgggggctcatccaagggtgctgctgctgacgatgactcttaaatagggattcactgttcacaaagttcttgaatttagattctatgtttgctctcttttttttttcctttttatttgtagttatgataattgtgccctttgtagtagtagttaggttttcagtcagatgtgtttaaagaatgctcttacgcatcaagaaaggttgttcaaaatttaaattattttaatgtcacctttgagtcttgatctagcatttgatttct

SEQ ID NO: 8478 - DNA, 1440 bp, Zea mays; identical to SEQ ID NO: 1457

SEQ ID NO: 8479 - DNA, 1440 bp, Zea mays; identical to SEQ ID NO: 1457

SEQ ID NO: 8480 - DNA, 961 bp, Zea mays
ccgggtatgaccgccccttctattcccttcctgctgtgaacaccctatccgaaccctaacttgagttatttgtattcgtacccgttctaatcgaagtgtgatacgtgtattgtacctccgccatttctttggcacgcagccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctggctgcttcggtgaagggagtagggttgatgtaacaagttaccgttgacgtgacagagtaggcttatcatcgacgtagttggggtcttacttgctgagcatctgcgacggcttgagacttttaggcatgtcttctatctccgaagcactctttcggtctttcctgatcagtgagctagcgctctgaaaacgtagcgatgagctgtcccattttcgactaactatttagtgccagtgaatggcctaattctacaactatcacgatgtgcctatatgttaggggattatggattctgtggtccgtctttgtggtatgggatttccgttggcaggcaggccagtgtgatatgcagttcacttcgtttatcc

SEQ ID NO: 8481 - DNA, 1952 bp, Zea mays
ctccatatacacaggggtaacgctccgcctcgcagccagcaggacaccactcatcttccttcccccccgcctcgtttccatcgccgccactctcttgctcccccgtaccatccctcgccaccgccaccgccgtcgctatgcagagcctcctcgtgcccactgctgcatcggccccggtggcggctccgcgggctcggcggaatctccctatgcgcctctccgtccgcgcctccgcgacggcggcagcggcaccgcggcgggagacggatcccaagaagcgggtggtgatcacggggatggggttggtctccgtgttcgggaacgacgtagacgcttactacgaccgcctgctagccggggagagcggcatcgggcccatcgaccgcttcgacgcctctaagttccccacccgcttcgccggccagatccggggcttctcgtccgagggctacatcgacggaaagaacgaccgccgcctcgacgactgcctccgatactgcatcgtcagtggcaagaaggctctcgaggctgccggtattgcccacggctccaagcccatggaaaagattgacaaaacccgggctggtgtgcttgtgggcactggtatgggtggcctcacggtgttttctgatggtgttcagaatctcattgagaagggctacagaaaaataactcctttcttcatcccatatgctataacaaacatgggttctgccctgcttggaatggatattggtttcatgggtccaaactactccatctcaactgcctgtgctacctcgaactactgtttctatgctgcagcaaaccatatccgtagaggcgaagcggatataatgatagctggaggcactgaagctgcaattattccaattggtgttggtggctttgttgcatgtagagcactgtcacagaggaatgatgaccctaaaacagcatccaggccttgggacaaggatcgtgatggttttgtcatgggtgaaggagctggagtcctggtcatggagagcctagagcatgcaattaaacgtgatgcaccaataattgcggagtatttaggaggtgctgtgaactgtgatgcttaccatatgactgacccgagatctgatggtcttggtgtttcatcttgcatcaagcaaagtctcgaagatgctggtgtggctcctgaggaggtcaactatattaatgctcatgcaacatcaacccttgctggtgatctggcagaggtgaatgccatcaagcaagtcttcaaggacccatctgggatcaaaataaatgcaaccaagtccatgataggacattgccttggtgcagcaggtggtttggaagccattgctactgtcaaagcgataactactggatgggtgcatccaagcataaaccaatttaacccagaggaagcggttgaattcgacacagtacctaatgtaaaaaagcagcatgaagtgaacgttggcatctcaaattcttttggatttggaggtcacaattctgtcgtagtatttgcgccatttaagccataaggtgttcctggcctcacaaaccttggtcagaacaacgaggatctttaggagtttctgcgttcaattttcatgtgttctctttaggggaagttatgtcagatctgagccggcaacgttacaaatgaactaaagctgagatacattgctttttagataactccaggttcacttaggttgtgcgcggctgtacaacgttgctttgaatcatttgtaattgattgtactgttttttcatgtaatggaagaggggttctgtagaagaagcacatttggaccttctagagttctagttcaataccacacaaatgaatttggagggtaggaattgtgtccctgctgctggatctggacgctttatggaaacttttttttttgaaatggcaatatatataatttacacgcgcgcttgagagaaacgtgcgctatctc

SEQ ID NO: 8482 - DNA, 2533 bp, Zea mays
ccctgcttcgctgttccctttccccgcccctacctggggcatctgcctctgaatcgcggcggctcccgaggcgccgcctggcgagcgtctaggcgccggtctacggcgacgatggaggtgtgatttggacgggagagagcgtggtggtgaggtctcggttttctcgatataggagatggcggcggcagaggcgcggggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcaggctacttgaacttgtaggccttgagatggaccttccagttatcatgatgtctgctgattcaagaacggatattgtaatgaacggaattaagcatggagcatgtgactatttaataaaacctgtcagaatggaggagctgaaaaacatctggcaacatgttattaggaaaaaatttaatgaaaacaaggaccatgagcattctggtagcctagatgacaccgatcgtaacagaccaaccaataatgataatgaatacgcttcctccgcgaatgatggaggtgatggcagctggaaatctcagagaaagaaaagagagaaagaagatgatgaaactgacctcgaaaatggtgatccttcttctacatcaaagaaaccaagagttgtttggtcagttgagcttcatcaacaatttgtgaatgcagtcaatcacctcgggatagacaaagctgtcccaaagaaaattttggaattgatgaatgtcccaggcttaaccagggaaaatgttgccagccatttgcagaaattcagactctacctgaagagaattgctcagcatcatgcaggaatacctcatccatttgttgcgcctgtatctagtgctaacgttgctccgttaggaggactggaattccaagctttggctgcttctggtcagatccctcctcaagctctggctgctttgcaggatgaactccttggtcgacctacaagcagtttggcgttgcctggaagggaccagtcatctttgcgagtggctgcaatcaaaggaaacaagcaccatgaagaaagagaaatagcatttggtcaacccatatacaagtgtcagaataatgcatatggtgcattccctcaaaacagcccagcagttggaggattgcaaccttttgcagcttggcccaataacaaagttggtatgactgattcaacaagcacattgggaaatgtgggcaattctcaaaatagcaatatgctattgcatgaattgcagcaacagccagacaccttgctgttaggaacccttcacaatattgatgccaaaccttctggtgtagttatgccatctcagtcgttaaatacattcccggctagtgagggtatctcacctaatcaaaatcccttgattataccatctcaacccccaagttttgtgtcatcaattcctccatccatgaaacatgaatctcttcttggattaccttcaacgtcaaccagtctgttgggcgggcttgatatggttaatcaagcttcaacaagtcaggctttgattagtagccatggaacaaatcttcctggtctcatgaaccgtagctcaaatgcaatcccttcaccaggaattagtaattttcaaagtggaaatattcattatgttgttaatcagaacgctatgggagttagctctaagccaccaggtgttctaaagaccgagagcactgactcactgagttgtagttatggctatattggtggtagcaccagtgtggactctggcttgttctcttctcagtccaaaaatccacagtatggtctactgcagaatcaaaatgatgttaacggcagctggtcgccttcacaagattttgatagttttggaaattctcttgggcaaggccaccctggtaccacttcatctaacttccagagttccgcccttgggaagttgcctgaccaaggacgagggagaaatcatgggtttgtcgggaaaggcacttgcattccaagccgctttgcagtggatgaggttgaatctccaactaacaacttgagccacagcattggaaacagtggagacatagtgaaccacgacatatttggatttagtggacatatgtgaaactttcttgaatttcgttgatcagtgagcactggaaacaaatctagtggtttgatgaatggttgctagtaatttcgtttcttttttttttcttctgtaattggtttataaagggaataatctatgtggcagcatgtggaatcttactttatagaagtttgttcagttcaaaggacttaaaattggtcagtcccttgtcatatagcttcttttctttgttctctttttctgtaattaccaattgtagcattatttttatgaccgtcgtaattcagcctagtcgatttattcccggcc

SEQ ID NO: 8483 - DNA, 1203 bp, Zea mays
caccagaccagctcatcatcacattcgcatacatctcttctagcacgcaaagatcgagctatatagctagctctgcaaccagagagaaggaggactatacccttcgccggccggcctaaggaggagtacgtacagaacttgggacatggaaaccgtcgtgggagacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcggcggccaaacaggaggcggcggcggcggcgcccggctgcacggcatcgtcagcagccgccacaaacaccaccagcagcagcagcgccgccgtcgtcgtcggctccttcgtcaaagtgagcatggacggcgccccgtacctgaggaaggtggacctgaggatgtacaggggctacagggagctccgggaggccctggaggccatgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcagcaatgaagatgatcccatctgatcgagaggacctgcatgcccggcaacgttgaacaacatgtcgatcgaacgtcatggtggccttattaattgtttctttcttttcttttcttccttttgtttaattatttttgctgttctggttggcgccgccgtggatcggagggatccccaagccgaaggatgagcttggctggcgcatcgaagcgcatgcaacggatgtgtgcggctttggttctgtaataggacaaccagtggtccttttttcgatctattagcggcacaaaaggagctagatgcatgctgaggttgtttcagttcactctccatgtgtgtctgtacaaacgaaacaatacagttatattgatcgttgatcccttatt

SEQ ID NO: 8484 - DNA, 995 bp, Zea mays
tcctccgagtcaacagtcttggctaccttctccatgaactcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 8485 - DNA, 1306 bp, Zea mays
cgcctctccctcctcttcctctcaacaccaccggcatacccatggcgaagtacggcgagggcgacaagcggtggatcgtggaggagcgcgccgatggcaccaacgtccacaactggcactgggcggagcgcgactgcatcgagtggtcccgcgcgcggctctcctcgctgctcgcgggcctcaccgtcctcgacggcgaggacggcctcacgctccgcaccgtcgcgctcgacaatctcgacggcgaggcctacgtcaacatccgcaagggcaaggtcatcccagggtacgagctctcgctcaccctctcttgggaggccgaggccgcttcggagtccggagctgtgaaggtcgccggcaccgccgaggtcccctaccttgccgacgagaacgctgacgaggaccccgacctccacatcaccgtgcgcggtgacgagacgcccctcgcgctccgcgccaaagatgccttcctctcccgcggcaaacccatggtgctcgaaaagatccgggagttcgttgctgccatggccaagggtggaccggcgaaggacgagctggattccaagaaaactcctgcgaaggtcgccgctgcagcgcctggcgccgctccggcgaagaaagaggaggtggtggctcctgcaccggctgcggggaagaaaaaggccaaggggaaggacaaggaggggttcaagaccattaagatgacggagacgttctactgccgctcaaaggacatatatgagatcttgatggatgagaacagatggaaagggtttacacagagcaatgcgaagatcagtagagaggttggaggggaatttagcctctttgatgggtgcatcactggcgtcaacgaggatctgcaggaaggaaaactgattgcgcagaaatggcggtttggaagctggcctgacggcttgtactcctcggtccggttgatgttggatgagcccgagtctggagttacagtcataaaactcaaacaaactggtgtgccagaggaagacaagtatgggaattcaactgtggttgagaacacggagagaggctggagagatctcatattccagcggatacgtgggatgtttggttttgggatctaaagagtctatagagaggcgatttaatttggcatgatgtcctaattcaaatttttacggggtcaggccatgaatgctatagcaatccatgtttctcacccagttttttttcttcatgtcggcaaaacgcaaaactctgcatatgatggggatttgaaaacatctgttattcatcaggctaaaacgctgcagtattccttgccccc

SEQ ID NO: 8486 - DNA, 1714 bp, Zea mays
cccctgtgctgtgtgctgtgagcgcgggcgcgcgcgagtgtggagagaagggagggaattcccccctttctgttcggcgccgtgctcgcgcgcacgcacccgcacgccccacgctgcacgcggccttttcctccgccttgctgctgcaagtccgcaaccactggaggaaaaatcttttccttcacttttcttccctttccccccgcgcatgcacgggctctgattgacgccatgggggacgccgcagccgccgcggcctccacgtccgctcccaccacgcccacctccatcctcatctgcctggaagacggcagcgaccttctcgccgatgccgacgatggcgccggcactgacctagttgtcgcccacgacgaacgtctgcttgtcgtagaccaggacgaggagtatgtagcgctgctcctgtccaaggagagcgcgtcaggcggctgcggcccggtggaggaaatggaggactggatgaaggccgcgcgctccggatgcgtccgctggatcatcaagactacggcgatgttccggttcggcgggaagaccgcttacgtggccgtgaattacctcgatcgcttcctggcgcaacggcgagtcaatagggagcatgcgtggggtctgcagctgctcatggtggcgtgcatgtcgctggcgaccaagctggaggagcaccacgctccgcggctgtcggagttgccgctggacgcgtgcgagttcgcgttcgaccgcgcgtccgtgctgcggatggagctcctcgtcctgggcaccctcgagtggcggatggtcgccgtcacccccttcccctacatcagctgcttcgcggcgcggttccggcaggacgagcgccgggcggtcctcgtgcgcgccgtggagtgcgtcttcgcggcgatcagagcgatgagctcggtggagtaccagccgtcgaccatcgccgtagcatccatcctcgtcgctcgcggcagggagacgcccgccggcaatctggacgcgctcaaggcgatcctgggctcatcatttccgcagctagacaccgggcatgtgtactcctgctacagcgcaatgattcgggaggacgacaagtcgccgacgcagtcgacgtcgacgtcgacgtcgacgggggtggcgtcctcgggcgtctctgtcgccgcgcacgccggggggagcgggagtcccagcccgggcgcttccgtgtccgtgggcgccaataatgccgctggcaccgccccgccggcaaccacggacaagcgcaacaagaggagacggttgcgctcacctcagcgacagtaggagcagctcagctgctggcagtgcagtccagctgcgttttttttttcagctcaccatttccttttgctgccgattgtttcttcaggggtggccgtaaatgcccgaattcgaacggggcaggatcggattcttcggattagtgcggtgtcgcagagtgatttggtaatttagtgccggaaagatttctttgttttgagatctttcgcgggaccaaagggaagggggcagtgtaaagacgacagaacaggcgtgaaggcctcgagagtcgagacctcacagggtaccgcctagcgcctactggggtgaaagtgaagtcaaggagtcgggagggtgtgtgtgaataccgtttgtagcagctagtgcgtcagtctgtcttttttttctgtttattaattattaatagcctgctagatttcatttg

SEQ ID NO: 8487 - DNA, 2157 bp, Zea mays
agctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcggaccttgtgaacaaccttggtaccattgcacgatctggcacaaaagagttcatggaggcactggctgctggtgccgatgtgtccatgattggtcagtttggtgtcggtttctactcggcataccttgttgctgagagggttgtcgtgaccaccaagcacaacgatgatgagcagtatgtatgggagtctcaggccggtggctccttcactgtcacacgtgatacctctggggagcaacttggcaggggtacaaagatgaccctgtacctcaaggatgatcagttggagtatcttgaggagcgccgcctgaaggatctgatcaagaagcactcagagttcattagctacccaatctctctctggactgagaagaccactgagaaggaaatttctgatgatgaggatgaggaagataagaaggacgaggagggcaaggttgaggatgttgatgagaaggaagaaaaggaaaagaagaagaagaagatcaaggaggtttctcatgagtggcaattggttaacaagcagaagcctatctggatgaggaagcctgaggatattaccaaggaagagtatgctgctttctacaagagcttgaccaacgactgggaggagcatctcgccgtgaagcacttctctgttgagggtcagcttgagttcaaggctgtcctgtttgtgccgaagagggccccctttgacctctttgacaccaggaagaagccgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctacgagtccttctcgaagaacctgaagcttggcatccatgaggactccacgaacaggaacaagattgcggagctgctgaggtaccactccaccaagagcggagatgagctgacaagcctcaaggactatgtgacgaggatgaaggagggccagaatgacatctactacatcactggcgagagcaagaaggccgtggagaactcccccttcctcgagaagctgaagaagaagggctatgaagtcctgtacatggtggacgccatcgatgagtatgctattggccagctcaaggagttcgagggcaagaagctcgtctcggccaccaaggagggcctgaagctcgacgagagtgaggatgagaagaagcggaaggaggagctcaaggagaagttcgagggcctgtgcaaggtgatcaaggaggtgctgggcgacaaggtggagaaggttgtggtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggagaacgccatcatggaggagctgcgcaagcgcgcggaggccgacaagaacgacaagtctgtcaaggaccttgtcatgcttctgttcgagacggcgctgctcacctcgggcttcagccttgacgaccccaacaccttcggcagccgcatccaccgcatgctcaagctgggcctcagcatcgacgaggacgaggctccggaggccgacaccgacatgcctcctctggaggatgacgctggcgagagcaagatggaggaggtggactagtctggctatcgtgtcttaatttgtgtgtgtgcgtgtgtttttttttacttctgctagcctgcaaacttcttacgtttattattgtgggtataatagtgctcctgctgcc

SEQ ID NO: 8488 - DNA, 2428 bp, Zea mays
tgatcacctatgacctagccgagctccgtgcctccgtccctccatctcccttttgcattccgcccccagattcccgaatcctccggctcgccccctctccgagactccgactgcctcccctgaagctagctagcctcctagcccctggtctggtcctcccgctgtgcctgtgaggcgctgctctaccaaggaggccgctggctgctccgctgcgctgcagtgaggctgcaaaagctggcggcttcttctcactgggcgtcgccataaacagtggagattcccatccccattttcccaattatggatagccagcggcaaccgggggagcaccgctgaggccgctcgcccgccatcccgcccgccattgctcccgtcgagggtcacagattatcctacatattgtagctccgcaacctgttcagcaaaatgaggccttcagatgacagggcacagctttcaggctttgcacaatcagatgaatcgacacttgatgtggaggggcattgctgccatcagccgtcattcccttgttcgccgtcaatgcaaccgattgtttctgggtgcacacacacagagaacagcgcggcatacttcttatggccaacatcaaacctacagcactgtgcagccgaggggcgtgcaaactactttgccaacctttcaaagggacttctgccaaagattggccgtcggctgcccaagggccagcaagcaaacagcttgcttgacttgatgactataagggctttccatagcaaggtactgcgttgctttggccttggaacggcagtgggcttccgcatcaggaaaggggttctaaccgatatccctgcaattctttgcttcgttgctcgcaaagttcacaagaagtggcttgatccggcccattgccttcctgccattcttgcgggtccaggaggtatttggtgtgatgttgatgttgttgagttttcgtactacggtgctccagctcaaactccaaaagtgcaaatattcacagagctcgtggataagttgtgtggcagtgatgaatgtattggctccggctctcaggttgcaagtcaggacacttttggaactttgggcgccattgtaaaacggagaactggcaacaagctggtaggtttcgtcaccaaccgacatgttgctgttgacttggactacccaaaccagaagatgtatcacccattgccacccaaccttgggcctggtgtttatcttggagctgtcgaaagggcaacatcttttatcacggatgatgtttggtatggaatctatgctggaacaaacccagagacatttgtacgtgctgatggggcattcatcccatttgctcatgactttgacatctccacagtcacaactacagttaggggtgttggtgatattggggatgttaaggttatagatctgcagtgtccacttaatagattaatagggaggcgagtatgcaaaatcggcagaagttctggccacacgactggaactgtgatggcttatgcccttgagtacaacgacgagaaaggaataagctttttcactgacctccttgtcgtcggtgagaaccgccaaacatttgatctagaaggtgacagtggaagcctcattatcctgactggccaggacagcgagaagccgcgtcccatcgggataatatggggtggcacagcaaaccgtgggaggctaaagcttaggtgtgaccatggccctcaaaattggaccagtggagttgatcttggccgccttctggatcgtcttgaacttgatcttatcataaccagcgaatcactcaaagatgccgtgcagcagcaaaggcgcgcgttggcggctgcagctaattctgctgctggggagtcgtcgacagcagcagctcccgtcctagaagagaaagtggaggagatcttcgagcctctggggatcaagattgagcagctgcgtcggcacgacgtttcggcctctgaagcggaggaggcagctgggatcaatgtggaagagcgccagttcatctcaaactttgtgggcaggtcccctgtgcgtgatgaccagggtgctccaaggcaaattgcgaacctgaacaatccgtcagaggaagagctcgccatgttgctgcacctaggcgaccagtagcccaagcggcttcgcagacagaatccgacctcgacgggaaacggcgaagcgctcatttcagtgtctctacatcgaagagtcgcaagtagtccgaagaaggtcacctggagttcagcaaactgaacctgcatcagtagcttagaccagcagcttcctggcacaaacattataatgaactatgctgaaacttgattcagcacttacatgatttgggtggtattcccttcagttttgctgtgctcgtgaagactttaatatgtacaatgctgagtccctgtatcaaaacaatgcaggtagtgat

SEQ ID NO: 8489 - DNA, 1403 bp, Zea mays
cacgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggccgcctcggagtccggagctgcgaaggtcaccggcaccgctgaggttccctacctcgccgacgagaacgccgacgaggaccccgacctccgcgtcaccgtgcgcggcgacgagacgcccctcgcgctccgcgccaaggacgccttcctctcccgcgggaaacccatggtgctcgagaagatccgggagttcgtcgctgccatggccaagggtggaccggccaaggacgagctggactccaagaaaactcccacgaaggtcgccggctccgcaccggcgaaggaggcggtactggctcctgcgccggctgtggagaagaaaaaggccaaggggaaggacaaggagggcttcaagaccattgagatgacggagaagttctactgccgctcaaaggacatatatgagatcttgatggatgagaacagatggaaagggtttacgcagagcaatgcgaggatcagcagagaggttggaggggaatttagcctcttcgacgggtccatcactggcgtcaacgaggagctgcaggaagggaagctgattgcacaaaagtggcggtttggaagctggcctgacggcttgtactcctcggtccggttggtgtttgatgagcccgagtctggagttacaatcataaagctcaaacaaactgatgtgccagaggaagacaagtatggaaattcaactgtggtagagaacaccgagagaggctggagagaactcatattccagcggatacgcggagtgttcggttttgggatctaaagaatctaaagaggcgatttggcatgaagttagatttcaaatttttacggggtcagaccatgcacgtcatagcaatccatgttttattcacccatttgttttccatgtccttaaacacagaacactgcatatcgtggggggtttaaaaacatctgttattcgaacgctgcaatgttgcttgctcccgaaatgagtcgacgctgatctgggttggttatcttgttgcaatgattaagaatgtgtgtcggtgtgaagcgttttagtggct

SEQ ID NO: 8490 - DNA, 2059 bp, Zea mays
gaaaattacctggtttgggtttagtctctataaaagaaatggaacagaggaatgttctggcattggatgaacatgttctaaaagctactgtttggaagcggaagcataagactgctatggagcaccctgaaggcaatgatgtgatggtgttctctcagcatgatcaaagaaagcaccctgtgatatttgacgacagagctaaatgtaagaagtctaaattaatttcctgtgggagtggagttatattggagtcatattggaactttaagacaagtgggctgcctgtgcgcgtgcttttctaccaacatggtgactggagtgattttccagaggatgttgtaaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagaggatcaatgatatcgcagaggacaacatgagagcacataacagattgtatgaagctgttggtgaaaatatttcaggtccttcattccatttgaatgaatattctagtggaaccatacaagctactggcaagccaaacaattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttgtcttgctcctgcaaactgtacaaattcatgcgccagatattctgattttcatgaagatggcatcatcagaatgatgttgtgccgtgtaataatgggtaatgttgaggttgttttgcctggatcaaagcaatttcagccatccaatggaagttttgataatggtgtggatgatcttcaaaatccacagaattacatcgtatgggatgctaatgtgcataaacacatatatgctgaatatgctgttattgtccaagcacctctcgtgaccaatgaatgttcgggcttgaaggatagcgtgcccaacatatctgagatcataagttctggttctcgagacaatctaaccaaggaggataggttcgcgccttgtggtgtcgaacaagaagcacctaagctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgatctggtggtacggatgaggcaaatagtcggtgataagatattggtttctacaataatgaggcttcaccaccagaagaagcccccatcgatggcagcagcagcagctgggctagcaagagcactcgcaaggggggaagagggagggggagtagccgagtaagattagtttaagccgccttgtcttttgagaaatttatggagcacatatgctttgtcgacatggccagactcaaggtgtcaaaagggagggagatgagctgagcaactgttgtagtggtctcaaactcaaagcgtttaggtcttgacatttgacaaactaaaactcagaaacattatcatgagtagtgtttttttttttcgtttctctttcctggatttaactattgttattgctatttcgtggatatctgggcactgaaggccctgctattgttggtt

SEQ ID NO: 8491 - DNA, 1766 bp, Zea mays
aatcgattccccctcctccgtcgctgtccggccgaccgcggagagcggagtcgatcgggggcgacaacgatggtggttagcgtggccgcgaccgggcccggcacggacgccgagccggtgagctccaccttcttcgcgtcccgctacgtccgcgacccactcccacggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgcctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgcgtcgtcgtcagggaggacttcagccgcagcctcgccgagcggctggtctcggacgtccgcaagatcctgcgcgagctggacgcgcgcgcgacccacgccgtgagggtctccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggtttggtgccgt

SEQ ID NO: 8492 - DNA, 1419 bp, Zea mays; identical to SEQ ID NO: 2787

SEQ ID NO: 8493 - DNA, 1964 bp, Zea mays
ctcgccgctgccgcatcctcaccctcgtccgctcctccgctgccccaaaccctagcctgaggaggggtcctcctccgctaccgagacccacgatgtcgaccatcgctgcctcccgccgctcgtcctcctcgtcctcttccgcgaccgccaagcgccccgcgattgcggacggccccgggggacccaaggcgaccgccgcacaggccaagaagcgcgtggcgctcggcaacatcaccaacgttgccgcgcggggagggagggcttccgttggcggcagccttgggaacgtcatggcgcccaccagcagcgcgaagttgaatccaacggtacccttgaagaagccgtctttggcaacaagtgctcggagtgtgagttcttccatccggggttctgctgacaaaccggcttccatcaagccagctccaccagtagcacgccatggcagcgcaacacaaaggcataacaatgttcctcctcctaaagtgcctaccattgccgatgtgccaagtcgtgctcctgccttggtgtcctgcaccggcttggtgtctcctggacgctcaggagattctgtttcatccgatgagacgatgtcgacttgcgactccatgaaaagcccagactttgagtacgtagacaatcaggacacctcgatgctggcttcgttgcagcgacggacaagtgaacatctgcgaatatcagaggatagagatgttgaagaaaataagcggaagaaaaatgccgtggccccaatggaaattgaccgcatctgtgatgttgacagtgaatatgaggatccacagctgtgcgctactctggcttctgacatttacatgcacttgcgagaggctgagacgaagaaaagaccgtcaactgatttcatggaaacgattcaaaaagatgtcaacccaagcatgagagcaattttgatagactggctcgtggaagttgctgaagaatatcgtcttgttcctgatactttgtacctgacagtcaactacattgaccgttatctttctggcaacgaaatcagccgccaacggctgcaattacttggtgttgcatgcatgcttatagctgcaaaatacgaggagatatgtgcaccacaagtagaagaattctgctacataacagacaatacatatttcagagatgaggttctagatatggaagcttctgtactgaattacttgaagtttgaaatgacagcacctacagcaaagtgctttttgaggagatttgctcgtgctgcacaagcgtgtgatgaggatcctgctttgcatctggagttccttgccaattacatcgctgagctatcactactggagtacagtctactctcttaccctccatcactaatagctgcatcggctattttcttggcgagatttatactacagccaacaaagtatccttggaattccacactcgctcattacacacagtacaaaccgtccaaactgagcgaatgtgtaaaggcattgcatcgcctttgcagcgttggttctggtagcaaccttccagcaatcagagaaaagtacagtcaacataagtacaaatttgttgcaaagaagcagtgtccaccgcagatccctactgaattctttcgggacacgacatgctagactagaaacccagaagtgattccagttgcttactggattcttcttgatgtgtcttgaatgcccagtgtagcacagcacaactatgcaagtgctgataacccccaggttgtttcaggtgattacaggggtgtaatcaatgtttgtggtcatgttaggtcattggtgtggtttttcttttcctgcttccagtctttctgtatgtagatcagtgttttcaggcgcttgtaaatccgagttctgtagtagagcacaatatcttgtaagttaactgaagaaatttggtgatcaaccaagttacctacaacttatgttgagctggtgatcaggtttttgcgctagttg

SEQ ID NO: 8494 - DNA, 1784 bp, Zea mays
cgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagaacatggagagagatgtgtagagagattgtcaagagcccagagttttctggaaaaatcacttttcctgtttccttgaagcagcctgggcctcgagatggaactattcagtgttttattaagagggataaatctacccaaatctacagtctgtaccttagttttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggctggtggcagtgtcccttgccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcaaggacatcttcaccatggactactgctacccgctgtcagccttccaggccttcgccatctgcctgagcagcttcgacaccaagttggcctgcgaataaatcctacctacaattctggtacctaccaaataatcaaaaacactgattgtcgtggtgttcgtccaagaaccgagtttagctgagacgccattgggcaccatgtgctggtgccttgttaactcagaaacgcgtgggggctgaatctgtttcagcagcttccttgtgataatctgtagctgctgcttcgctgctgttgtatcctatgctttcatttctttccggtt

SEQ ID NO: 8495 - DNA, 865 bp, Zea mays; identical to SEQ ID NO: 2702

SEQ ID NO: 8496 - DNA, 1210 bp, Zea mays
cccactttcattgagagacgaacacgcgagtagagaatttctcctgcctgctcacgaccgccctctcgccggtcgccggtcgccgctcgcaacgcaagtcggaagaggaatctctccaagctccaatcctccgatcctgccccaacccaagtcccctccaccaggccgcacacctccgccgcccggcgcgaccttgcatccaccagcctgccctctccttcgcgtgaggcggccccggcgaccgcgtcggcagtgcaagaccagaccgaggcttctcccgttggaaggttccagccatggcgagcgccgatctgctgcggaaggaggaggagttctactcctccctctttgattccgcaaaaggcgacggcgtcaagtcgcgctcgcaggtgattgagaggaagattgaatccctcgaggacatggccaccaaggtcagcaaccggagatcaagaagatggttgaacgaccgcttgctgattgagcttgtcccacgccttcatgttgaagaaatcaaaggcctctttgctcctccaccatggggtgaggagctgcccttgtcagcattctgcaggacaagtgttagtgactgggaggccttcaggagcatcgacatggatgctgaggcaagattgatgcaacacatgaaacgatcatccgaaaaacaaaggactcatgtcgacgaagatgaattgattgctctgaatgcttggcgtcgtataggtcgccaaacaagagaagctattaagaaaaaatttctacctgatctacttcaaatatatgaagaacaggttagggccttcattgaaggtactggtgacagcgacgtgcttgtgctgaatgtccaggacccgttccagaggctgcttctgcacggtgtttgtgagttctataacgtaacctcaatgaccacaagcagtgtaagggacgggaagccatggaagagcaccaccatcaagaagaggcatgtcaccggtcttcctccgagaatcacattagttagcttcctgaggatgaggaagaattagtcgtcccagtaacatgtggatgtgagggtcctacactaattcgcctggatgtgtactaaaaagacaaatttgttgctttaggtcgcatctagcatgtaatcaaatgtaaaatatccatgtcaaatgtaaaatacattgcaagaccttgttccagatgaagaaactcaaaagtgtaagcccct

SEQ ID NO: 8497 - DNA, 1779 bp, Zea mays
cgtcccccctcaagaactgtacccatcacgcgccgccatcgattgaccttgaccgacccgaccacccatcacgcttcttgttgccgccgctgttgcttgccgatacgcggtggctgcgctcgccggcggggaagaggggtcgcgggctgcgcgcctccagtctttcttcgcctccgtgctctcgggcctcttcttcggccaggccgatcaggacgaggaccaagagatggcctcgcgcaaccacaacgccgccgctccgcagcttcaccatcacaaccgagccggtgttcccgctcttggaaaggccaaggccgtgcccgcccgagctgacgctctgaaccggcgaccccctctcggcgatataggcaacctcgtcagcgtccgcccagccacagggaacccgcaggagcaggtcaatcgccccatcactagaagcttcggcgctcaactcgtcaagaaagcgcaggcgaaggccgcaatcaagaatgccgcaatcctgcctgcgaggcatgcgccgaggcaggagaggaaggctcctgtcaagcagcaaccgccgccggaggatatcatagtactcagctccgattctgaacagagcagggcgcagtccgagagcagcgctagctccgtccgctccaggaggaaggccatcaacaccctttcttccgtgctctcggctcgctcaaaggctgcctgtggaatcgctggtaagcctagacaagtggtcgatgacatcgacaagctggacgtcaacaatgagctcgcggtggtggaatacattgaggacatctacacgttctacaagattgctcagcacgagagacggccatgtgactacatcgacgcccaactcgagatcaactctaagatgagggctatcctggctgattggataattgaagtacaccacaagtttgaactgatgcccgaaactctctacctgaccatgtacatcatcgatcagtacctctcgctgcaaccagtcctgcgtaaggagctgcagcttgtcggcgtttcatctatgctgatcgcctgcaagtacgaggagatttgggccccagaggtgaacgacttcatcctcatatcagacagtgcatacagtagagaacagattctttcgatggagaagggaattctgaataggctggagtggaacctgactgtccctacagtgtatatgttccttgtccgttttctgaaggccgcaacattgggcggcaaagttgagaaagagatggagaatatggtgttcttcttcgctgaattggcgctgatgcaatacgatttggtgacacgcctgccatcgctggtcgctgcttctgctgtctacgcagccagactcactctcaagagggctcccctttggaccgacaccctcaagcaccacacgggcttcagggagtcagaggcagagctcattgaatgcacgaagatgctggtgatcgcgcactcgactgcccctgagagcaagctgagggttgtatacaagaagtattccagcgagcagttcggaggggtcgcgctgcgtccacccgcagaggagatctgcaagtgaacgaaggctactttatccgtgtttgcctattgcttgctttaggggaagtggcgatggaaggcgagtctgacattcgctaggcttttttatgtttgcttgtttcagacagccgtttgtttgctaggctgttctcagagtcggttgttatctgacttgtgatggcaactataattctatctagtacaacatttttattcataaatgtgaatggtgttttacaaggt

SEQ ID NO: 8498 - DNA, 1419 bp, Zea mays
ctcgtacgccgtcgcttcctgcggtacgtactctctgtccgcagcgttcctccagctagtagcagtagcagctagctagctagctagcaactggccatcggggctgctagcagcgtacgtacgtggcgcgatggctcctccagctcatgataggctccgccgcctggtgctgctcctcgtcgttgccaccgccgcggcggctttgcttctggcgccgacgacggcggatgctgcgctgccgcgggtgcagcacacgcccaccaaggccgacgggtcgctcgccatcctcgtcgtcggcgactggggccgccgtggacagttcaaccagaccttggttgcccagcagatgggcgtggtggggcagaagctggacatcgacttcgtcatctccaccggcgacaacatctacgacgacggcatcgccaacactagcgaccccctcttcaaggaatcgttctccaatatctacactgccaacagccttcagaagccttggtacctggtccttggtaaccatgactacacgggaaacgcgctcgcgcagctcgaccctgccattcgcaaagtggatagccggtacaccgccattgccaagtccttcattgtcaactcaggggttgcggattttttcctcgtcgacacaacgccgttcattgtccactactggaacaacaccaagttcgattggagaggcgtcgctcctcgagacacctacatcgcgaatctcctcaaggacttgaagtgtgcactgacagcgtccaaggctccctggaagatcgtcgtgggtcaccaccccatcagcagcgcctgcgggcatgggaacaacactgagctcgaggagttgcttctcccggtcctcaggacacacggggttgacatgtacttgaatggccatgaccactgcctgcagcgcgtcagcagcagagacagtcgtcttcagctactaaccagcggcggcgggtccaaggcatgggctggcaagttcaagcccaccctcgacaaggtggagttcctctacgacggccaggggttcatgtcgatgcgcctgagcaggacggaggcccgcctcgcgttcttcgacgtcgctggcagcgtcctgcactgctggaccatgcatgcccaaaaattaaagacgacgacgacgacgactgctgctgctgctgcagccgggcactaaagctttgctggatcggagttattaatgttcgttgctgcctcgcggcggtacgatgagttgatgatgcaattaattatttggttttgtcgtcttttcgtgcgtgagagggaagcaataataattatttgctgctgcttccgttgtgtgcacatgcatgtgagggtgtcaagtatgttcagcctcttgcaagataaaatctctcgtcttctatggaataaactgggaaaagagttttttttggt

SEQ ID NO: 8499 - DNA, 1378 bp, Zea mays
ctccgtgcttaccactcgccattcctaagtcctaactacctccacccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgtttcccacagggtagtcctcgcaccactgacgagacagcggtcctacggcaatgttcctcagcctcatgccatactgtactatcagcagagggcgactaaaggaggtcttctgatcgctgaggccacgggggtttcagacactgctcaagggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgcgcgatctccactgggtatgctgatttggtcgcgttcgggcgcgtgttcttggctaatcctgacctgcctcggaggttcgaagtagacgctccccttaacaagtacaacagagacacgttttacatccctgatccggttattggatacctgactacccatttctttcgtcagatgtataaatgttctcttttcagcaatctgctttttagattgtgtagtaactggttggtgtaccagtaaaatattagacgaataaaccattggtctgaatgcctcattctcatatatatggacaaaagcaatatgatcgttgt

SEQ ID NO: 8500 - DNA, 1060 bp, Zea mays; identical to SEQ ID NO: 7601

SEQ ID NO: 8501 - DNA, 1399 bp, Zea mays
tgcgggagtgatgtcgaccactttatgagctttcccccctgctattttggggtttatccctttagattcgctctagttatggcggatcttgacatggagcattaggaatttctttcgtcgaaggcggcgcggcgccaggtcgtggcatgcgcagccatttgccggtcgtggcgcgaggtcaccaaggaggtggtgaagacgctcgaggagtgtggcaggattaccttccccatatcccttaagcagccggggcctcgtgaaatgccggtccagtgttttgtgaggagagagagggcaacatccacatatctactctacctagggctcagcccatctatgaatgtggagaaagacaagttattgcttgctgcccggaaggtcaggcgtgccacgaggacttattttgtgatatcactggtctctgatgatttctctcactctagtagcacctacgttggcaaactgaagccaaacttcctcggcacaaagttcacaatcttcgacagccagcctcctcctgacgctgtagtgctaccaaacaataagacaagcaaaaggcagtccaagcaagtatcaccgagactgccgctaggcaattacaatgttgctacagtcacgtacgagctcaccgtcctacgcaacaggggtccaaggagaatgcaatgcaccatgcactcaataccagctgagtgcatccaggagggcgggaaggcccctacccctacaggcgccatccagtcgcttgacgagccagtgtccaccttacctagtgccaaagggaaggaagtggctgtagaattctcttcgacaagcctcagcgccgatctgtctggaccggcctgcgtgaacggaacacctctagtgctgaagaacaaagctcctcgttggcatgagcagctgcagtgttggtgcctcaacttccgggggcgtgtgaccgtcgcgtcagtgaagaacttccagctcgtcgcctctgttgatccttccctaaacatccccgcagcggagcaggagaaggtgatcctccagtttgggaagataggtaaggatatattcaccatggactaccggtacccactctcggcgttccaggcctttgcgatctgcctgaccagcttcgacactaaaccggcctgcgaatgattgacggtagtttaaaatcccgggtggtggagtcttgtgtacgtccgtgttcttccagggcgatgtaaattctttatcttgccatgctgggcctctgctgcccaggcgaaatggtagcttgtgaggtggagatgagcgatagcatctgtaccataggaagagatttgagcgaccttgtttacccaactgttatatgtattattgctgggatgtttggctgtgaaatatcactgccgtatcgataatggacgttgtgacc

SEQ ID NO: 8502 - DNA, 977 bp, Zea mays
acctttcctctcttctcccgtccggccgtcccctcttccgcggcaaccccggcgcggcatggcgagcccgtcctcctcatctttcccgtcccggaaggccctgagcaagatcgcctgcaggcgcctgcagaaggagctaacggagtggcaggtcaacccgcccgccggcttcgagcacagggtcaccgacaacctccagaggtgggtcgtcgatgtagccggggcaccaggcacgctctacaccggcgagacctacaaactgcaggtggatttctccgagcattatcccatggaggcacctcaggttatatttctgcatccagcaccgatgcatccacacatttacagtaatggacacatctgtttagatatattgtatgactcgtggtccccagcaatgactgtcagttctatctgtatcagcatattatctatgctgtccagctcaccagcaaagcaacgcccagccgataacgatcgctatgtcaggaactgtcgcaatgggaggtcaccaaaggagaccacgtggtggttccatgacgacactgtgtgatgggtggttccggctgttgtcctgcccgcattttagttgccagactacatgggagatgatctaggcatatttcaagcgacccatttgaccagaaactaacacgctcttctggtttgtaaatgagtgtgcatcagcgtcaggtctctgtacttgttgatccttacaccgtctatagtatgtagaataatgtttgtatctttgtcaatttacggaacagacatgaaatgcaggtcactgttgacttgcaagatttctgaatccttctagttgaaagttgaaacgagggttatatatgcttggtagtctgctccagatgcagcagctttagctctagttccacttaactctagctcaaactatggcagagctcttttgggagtggctgtgtgatcgtgtaataatatatctgttgtgtgagtattgc

SEQ ID NO: 8503 - DNA, 1757 bp, Zea mays
catctcccagatccaattcgcgagttctccctcctctgcggccatggcgctctctgtggagaagacctcgtctggacgggagtacaaggtcaaggatctctcgcaggcggacttcggccgctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttgcttttgctgaagaataatggtgtagtcggctggggtgaggcgatgtgcgttgccagatacagttttgtcttgttgactctacttatctgattatcatttgtaagcgatttgctcaagttatttgtcgtttatg

SEQ ID NO: 8504 - DNA, 1102 bp, Zea mays
tctgccttttccttttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtacccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagggggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatac

SEQ ID NO: 8505 - DNA, 1353 bp, Zea mays
gaacgcggttttgcacaagcgagcaaagagagggagagagagaaagaaaagaaaagaaaagaaggggagggccgcgactgtagtggggagatgcctcggcatactgcgcccgcggcgccgccatcggagcgcggcgagatggacgaggtggtagaggcggatccggacacggaggcggaggatcaggaggagaggtgggcgacgctgctaccagagttgctctccgacgtgttgctgcgcgtcgaggcctccggcgccgagcagtggccggcgcggaaggacatcgtctctttcgcctgcgtgtgccgctggtggcggaaggccgcagtctccgttgtgcgtcctccggcggagtccgccaagatcaccttcccctcctcgctcaagcagccagggcctagggagaacccaatgcaatgctttatcatgcggaataagaactctacattctacctctaccttggcttcacaagttcacctgtgtataaagggaagtttctcatggctgctagaagattaaggcgtggtccccatactgagtacattatatctcttgatgcagaggacttatcacaagggagcaattcatacatgggaaaactgagatctgatttctgggggacaaacttcaaaatatatgatagcaagccaccatatgacggcgctaaagcatcaagtagtcgatctagtcgtcgtttcggaagcagaaggattagtccccaagtatcgtctggtaactatgaagttggacaggtttcatacaaatacaacttgctcaaatccagaggccccaggagaatgaattgcactcttgaatgcccttcagcgcaagagacctgggaaaactcactcaagacaaagttcaggaggcccttgggtcccacaactttacgaaacaaagcgccccgctggcatgagcagctgcagtgctggtgcttaaacttccatgggcgggtaacagttgcatcggtcaagaatttccagcttgtgactgctgccggccccagtgaccctactagcaacgtggacgaggaaacggttctgctgcagtttggtaaggtcgacgatgatattttcacaatggattaccggcaaccgctctctgcgttccaagcttttgccatcagccttagcagctttgggaacaagctagcctgtgaatagcgatacggttcgatgctcgtcgcgtggctatatggtttgcggtggtgggtgcttgctcgccgttgttacaatgtgatctgttctttttttttagttgagtatcgacgtactatttgtaccatgctgttgtacaagagatgcactatactgcattactgctgtcttgtcaaaaggacttgttcaagaagg

SEQ ID NO: 8506 - DNA, 1410 bp, Zea mays; identical to SEQ ID NO: 7657

SEQ ID NO: 8507 - DNA, 1199 bp, Zea mays; identical to SEQ ID NO: 7633

SEQ ID NO: 8508 - DNA, 936 bp, Zea mays
cgcaactgcccgtctgctcctgcttttcatccagtcgcaaaacaaagagaagagatctccgcgtccgcaaccgcatcgcttccctcccggcagaagaagaagattcggttgggttgtttgtctcttgcaaaccgcaatggctgctgctgccactgctactccggccgtggcgccggaggccggcgaccggaaggcggtggcaccgccggtcgacgcggtggatctggagctggagctggaggagaagcacgtgctggcggtggacgacagctccgtggaccgcgcggtgatcgccaagatcctacgcagctccaaatacagagtgacgaccgtggactcggcgacgcgcgcgctggagctgctggcgctggggctggtccccgacgtgaacatgatcatcacggactactggatgcccgggatgaccgggtacgagctgctgaagcacgtgaaggagtcgtcggcgctgcgggccatcccggtggtgatcatgtcgtcggagaacgtgcccacccgcatcagccggtgcctggaggagggcgccgaggacttcctcctcaagcccgtccgccccgccgacgtctcccgcctctgcagccggatccggtgaccgcccgcgcaaggatggaggatctggttgcgcgctctgacttaattagaggagttgttaggatccaattttttgtgtgttcgttcgttcgttcgttcttttctttctttcttcttggacatagatctgctgccgccgctgctgccgtcgactgaaacaagaagctaacttagttttagggtccaggttgttgttgttgttgttaggaaggcgagtcgttgggggcattcacggatgttcttcctcgtttcccctccctccgtgcctgaggctgcaaaaatatgccccccagacatgaaaaaaaaacaagacctgttaacagttcc

SEQ ID NO: 8509 - DNA, 1594 bp, Zea mays
gcggcgacacgccagggcggagagcacacaccgaagcgggccgcggcggcggcgcaggcgcaggcgcttacatgggagtagaggcgggcgggtgcgggcggagggcggtcgtgaccgggttctacgtctggggctgggagttcctcaccgccctcctgctcttctcggccgccgccgccgccgcagactcttactagctagctagccaccttcttcctcctcctccttgtaggtagtagtagtagtaggctacacaacaacgaccacatatatatatacatactaggtactactagcaggcgagcgagattcgtgcagtaattaaggccgcagccagttaataataattagtcgtcggcgagcgagagagatggtggaggaaggcgccaccgcggcggcgtcgaggagcgggccggcgccgttcctgagcaagacgcaccagatggtggaggagccgggcacggacgaggtgatctcgtgggcggagcagggccgctccttcgtggtgtggaagcccgtggagctggcgcgcgacctcctcccgctccacttcaagcactgcaacttctcatccttcgtccgccagctcaacacctacggtttccggaaggtggtgccggaccggtgggagttcgcgaacgagaatttccggcgaggcgagcaaggcctcctgtccggcatccgtcgccgcaagtcaacgacgccgcagccatccaagtacggcggcggcagcgtcgtgaacaccgcgttccctccgccgttgccctttccgcctcccgcgtcggtcaccacgtctggcggtggcggtggtgctggcgctggcaacgagcgcagctcctcgtcggcatcgtcgccgccacggaccgacgacctgaccagcgagaacgagcagctcaagaaggacaaccgcacgctgtccaccgagctggcgcaggcgcgtcggcactgcgaggagctcctgggcttcctctcgcgcttcctcgacgtccggcagctcgaccttgggctgctcatgcaggaagacgtgcgagcgggtgccggtgacgacgccgcgccgcgccgcgcaatggtcagccagctggagcgcggcggcgaggaggggaagagcgtgaagctgttcggcgtactcctcaaggacgccgcaaggaagagggccaggtgcgaggaggcggcggccagcgagcggcccattaagatgatcagaatcggcgagccgtggatcggcgtcccgtcgtcgggcccggggcggtgcggcggcgggaattaagtaaggtatggttggaactgatgcgccacggccggccgtgtgacagctttattacagcgagcgcatgttcgagtcgtggatgctttttgtgcgtgtttgtatttgtcatccaaggtgaggttgatggcaaggataattccagtgctgtggtaaaactgtgaaggcagaacacagggcacaggagataaccgtaacgcatgttaaaagttaattatgggatgctttggaggtagcaagattgaaagtagggaactagggatgaccggatgagtagacggtctagaaagacaagcccatatgtttggaatggaatattatcgtttttat

SEQ ID NO: 8510 - DNA, 1126 bp, Zea mays
gccttttccttttccttcccccgctttctccttccttcctcctcctcccggctcccctcacccagccaccggccatgtcggtggagacggagcggagctccaccgagtcctccggggcttccgggctcgacttcgaggacaccgcgctcacgctcaccctccgcctcccgggctccgcgccttccgccgccgccgccgccgcggcttccctgtccctctcctcctcgtcgtcctccgccttccccgaccccgaccgcaagcgcgcctcctccgacgctgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgggacggagtacgtacccacgtacgaggacaaggatggcgactggatgctcgtcggcgacgtcccctggaagatgttcgtggaaacctgccagcgccttcgtctgatgaaaggttcagaggccgtgaacttggcaccaagagccgcccgatgaggcacactccgttgggcgttggcacgcacgcacgcactggcgtcttgaaggaaagggggaactctgctggtcttgatgaggatcttcacgtgagataggaacgtgtgtacagttgtcgccttatggtattgagttgaggaaacttggaagttccattacttgtctgtagtctctactttatatagatgcgaagaagcttgagatacacattgcctacaatgtcttttgatgaataagaccagacagcaccgaaccgaactcgtcctccacacggttgctttgccatctcggtggttttgtggtggtggtggtggtcgtgcttcctataggtgtgaggctgatggcgtggctgccatttatacaatctttaatcgtgttttgttgagctt

SEQ ID NO: 8511 - DNA, 1154 bp, Zea mays
gcggcggtcggccaggttcgggagatcacttcgtcgcggcgaggagggagggggtcgccgttagcgcgcggcacttggatgagaagggcagcggtggaggaggatgcggaaggcgtacagggactccatcaaggtgctcgaagctgacatccagcacgccaacaccctggcctccgagtttccccgggactatgatggtgcgtgcctgcagatgcggctgtcgtacagtcccgcagctcatatattcctcttcctggtgcagtggacggactgcagcctcgcaggggctcttggtctgctgagaatcctcatatacaaggtttatgtggatggcacaacaaccatgtcgactcatgagaggaaagccagcatcaaagaattctatgctgtgatatttccttctttgctgcaactgcaaagggggatcactgatgtcgaggacaagaagcagaaggccgtatgcatggagaagtacagaaagaaagatgaggatggacgggacaccttatctgatattgatgttgagagggaagaggagtgtgggatttgcatggagatgaacagcaaagttgtgttgcccaactgcacccatgctatgtgtatcagatgttaccaggactggagttcaagatcgcagtcctgcccattctgccgtgacaacctgaagaagacctgtcctagtgacctgtggatatatgttgaggaccaagatgtggtcgacatggagacggtgtcgagcgagaacctcagacggctgttcatgtacataagcaagctgcctctgattgtcccagacgtcatcttcagcgtgtatgattcccacatcaaatgatttccgacgcgaccttctcgacgaccttcagccagtgcccagctccagttaatcttatgcccccatgtcctccattttcatgctttgctcaagcttttggaagtgcctgaactgatttggaaccgcaagccttccggtggtgctttagaaagttgtttagtgcctgcatgcatccttaatcatatgcagccactctgtacatatctgacttcgctcagttaataggggactgtgcttgccccaaatggaggcagggccgtttgtgtctttctcatgtttccattagcgaagcaacgcaaagttctgggcattggaaggtttc

SEQ ID NO: 8512 - DNA, 1768 bp, Zea mays
ggcggcggggccatgccgctgtactacgggaccccggcctcttgctcaggattgagctcggtgagcttgagcaccagcatgcagggggcaatggccagggtgagggccccattcacgccgtcccagtggatcgagctggaacaccaggccctgatctacaagtacctggccgcgaacagccccatacctcacagcctcctcatccccatcaggaggagcctcgctgcgtctccctacccgccttcatacttcggcacgagcacattggggtggggctctttccagctgggctactccggcaatgcggatctggagcctgggcggtgccgccggacggacggcaagaaatggcggtgctccagggacgcggtcgccgaccagaagtactgcgagcgacacatgaaccggggacgccatcgttcaagaaagcatgtggaaggccagcctggccatgccgcgaaagccatgtccgcggtggcggcggcggctgctgctgctacccagcctgctgctatggccggcgccggagctcctgccgctggcctcactgtcaatcagcaccagctgacggcgaagagctacgccacgggtgcgactgacccttgctctctgcaatataacagggaactggtgaacaaacagaatgagagcgaaaacatgcaggactccgacaacctctcgatgctgacttccatgaacacaggaaacacaggcagcgtgttcccattctcgaaacaaaacaccaatccttttgaagtgaccagctcaaggctagagttcggcctcgtttcatcggattcactgatgagttcccctcacagttccttggagaacgtcaacctgctcggctcacagagtatgaatgaacaccagaacccagcctccctgcaacacttcgtggactggcccaggacgcctgcccagggaggcctttcatggcccgaggcagaagacatgcaggctcagaggtcacagctctccatatctgctccgatggcatcctccgagctatcgtcggcctccacatcccccatccacgagaagctgatgctgtcgcctctgaagctgagccgcgagtacagtccgactggtctcggcattgcggcgaacagagacgaggttagccagctagaagcaacctgggcgacgatgttccgtgactcttcgatgggcggtccgttgggggaggttctggccaagaacggcaacgtggaagcgagaaattacctgtcggcgcctctgaaccttctcaccgactactgggattcaagccacgggatggagtcctcccctgtgggcgttctgcagaagacgaccgccttcggatcggtctccagcagtacagggagcagccctagggctgagaaccacggcgcctacgacggtttcggcaacctgcgggatgatctcggctcaattgtagtgcgccatccaagcatccgccttgtgtgagcctttctgagttctgaccatgaaaaactgcaacaagacggcggcccgcagccatagaagtgggcatatgggctactatgctaatcctcaaagcgtgagggggggcatttacctcgtagtttgtcatttgagactgatctcctgttttttgtcacttcagttcttcttttgcttccctttttaacttggctttgtaactttcaccttccttggatcgtgaaaagcgatgtggtgtgtggtgtggatggatttggtgcgccgctgatgcatatcatcatgtgatagaagaagccagtatccgtcgaggattactgcg

SEQ ID NO: 8513 - DNA, 2346 bp, Zea mays; identical to SEQ ID NO: 8012

SEQ ID NO: 8514 - DNA, 1058 bp, Zea mays
gtggtacagttgtactgagctgagcttccggaggcagaataggagaggcaggcgatgacgatggcgacgaaggcggcgtgcgtgctggcggtgtgggtgctcgtcgccttgggcctgtgcgacctgggctcaacgcgcgcgcccctgggcagcaagccgcagcgggagttcgactacttcgcgctctccctccagtggcccggcaccatctgcgcctccacccgccactgctgcgccaccaacggctgctgccgctcggagcctctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcgccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagagatcatgacacagttcgatgaatttgaggtgcctgcagctctttatacagcttaaaatgcaattattgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcac

SEQ ID NO: 8515 - DNA, 1744 bp, Zea mays
ctagatctttcaagctatccttgcttcctagctccctttggcgtgctgtaccggacgacaggggtaggtaggtaggtaggtgtagctagctcggcgagcgagggagcaatccggccaacagcacacgcgtcgatcgccatgccgagaagcggcggcggcggcaatggcggtggcattagtagtagtagtagggtgatgcccaacctcccggccgggttccgcttccaccccacggacgaggagctcatggtgcactacctcatgaggcaggccgcctccatgccgtgccccgtccccatcatcgccgaggtcaacatctaccagtgcaacccctgggatctccctgccaaggcattgttcggcgacaaggagtggtttttcttcagcccccgggaccgcaagtaccccaacggcgcccgccccaaccgcgccgccgggtccgggtactggaaggccaccggcaccgacaaggccatcctgtcgtcgtccacgcccacgagccacggcggcgccaacatcgtcgtcggcgtcaagaaggcgctcgtcttctacggcggcaggccgcccaagggcaccaagacggactggatcatgcacgagtaccgcctctcgggcgcggcggacgacgactgcaagggcagcaccaggcgcagagtgtcttcctcctcgtcgtcctccatgaggctggacgactgggtgctgtgcaggatccacaagaagagcaacgatttccagttgtcgtcgtcgtcggagcatgagcacgagcaggaggagccggcggcgggcggctcagcgacgactgtggaggaactagacgctctcgtcgtcgtcgacaacagcagcagcagcgacaccaccaccaccaccatcaccaccaacgacaacaactctactgaaacagctgcgactcatcacgatcctcagacgatgatgatgctgagcaagtcgtgctcgctcaccgacctcctcgacagcatcgactacgcggcgctctcctcgcagatgctcctcctcgacgcgccccacccccacgctgatgacccgccgccacacatggtctactacccaccggcggcgtcggcgacgcaccagcaagcaataatagctaataacaccaacagtaatgacgactactatgacgacgacaacttgttgccgactgctgctgctactgcggtagacgcggcggcggcggcggtgctactcagctcgtcgcctgcagacaccaacggtgtgaacaagaggaagcgagtgacggccgtggactactacggcgccgctgaaccgccgaccttcttccaccaccacctcgatgatggcggcaacagcttcttcagtacgaccaagaagctcaagccgccgccgccaagtgattcgaggcatggcggccatttcggcaccgccacagcgagcagctaccgcgacagccagcagctcgtggacagcgcgagcagcagcggcgtcttcttccatcagtatgggtacggctacagcagcagcaacccgttcttgaacttgaaccagcagcagcagctgctactcaacagccacatcgggatgcagtagagctcgagagatcgagagagagagagagagagagatgatatatcattggaaggatcagcacgcgtacgtgcagattaattgcagcgagttctatcttgtttgctttcattattatatactccgtatgtgtcgttcatgtaaaattagtttaaattgtaaattagtgtgctgaaattcc

SEQ ID NO: 8516 - DNA, 1115 bp, Zea mays
ctgagaaggaaaagcagcggcttctcgcgcggcgcttcgatctaccggggagtcaccaggcatcaccagcacgggcggtggcaggcgcgcatcggccgcgtctcgggcaacaaggacctctacctgggaacgttcagcacgcaggaggaggccgcggaggcgtacgacgtggccgcgatcaagttccgcggcctcagcgcggtcaccaacttcgacatcacgcggtacgacgtggacaagatcatggagagcagcacgctgctcccgggcgagcaggtccggcgcaggaaggaaggcgccgacgccgcggtctcggaggccgccgccgcgctggtgcaggccggcaactgcatgacggacacctggaagatccaggcggctctgccagctgccgcgcgggccgacgagcgcggcgccggccagcagcagcgccaggacttgctgtcgagcgaggccttctcgctgctccacgacatcgtgtccgtcgacgctgctgctggtacagggacagggacagggggcatgtcgaacgcgtcgtcgtcgctggcccccagcgtgagcaactcccgggagcagagcccggaccggggcggcgccagcctcgccatgctcttcgccaagcccgtcgcggcgcccaagctggcttgcccgctgccgctggggtcgtgggtgtcgccgtccgcggtgtccgccaggccgcccggcgtgtcaatcgcgcacctgccggtgttcgccgcgtggaccgacgcatgaacaaacatccgtgtcattaccagggtatggttcttttggtttgcttagagcgtgctttttagctgggtaaggttagctgcgtagcggtgatctgatcagcatatgtgagaggaactagccatgcgtgtctgctttgtcctcctgcgattcctcctccagttgcgttgcgaggaggtttctttttgtaataccggggctagatagcacagcatggatctcctcctgtagccaacactaatttggagtaggatggttagtgttgatctcctaacttcaattaggaaaaatatgccaagtaagataagtttaaacctgtgcgctttgcaattcatcaatgagctgggattcagacctcaaaaaaa

SEQ ID NO: 8517 - DNA, 1304 bp, Zea mays; identical to SEQ ID NO: 8015

SEQ ID NO: 8518 - DNA, 1302 bp, Zea mays
cggccatcggactccaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtgtatattaacacggctcaagagtttgatggtagcgattctggagcacaccccgatgaagcagtctcatggggcaagattaagggttcagcaaaacctgtaaaggtgcattgcgatgcaagtatcgctttcccgcttcttgttgcagcaacatttgcacgtaaggttcataactccaaatgaacagactgaatgggattcggtggagtgaatgggcaacagaattttgttgaactctccaaatgaccttttggagcacgaggtctacttcacttgcacagggatcatgtgcaaattttttcggtgactcgcggcaaccacatgccatcattcttcgatgttcacttgatgctgtactagctggttgatagcatttttgttacaacagataatttattgaaatacagacatacgattgtccatccgagtcgtctgcttacgatttttttgtagacgaaacatctgcttacgaaatcgacaaatggcctgttttatgaac

SEQ ID NO: 8519 - DNA, 1162 bp, Zea mays
gtcctccaccaccattcatcagaaagcgaagcacaagcctctgatgccaagccaaagcacacacacctcctccagcctttcttcctctacagccccaattcttccctgcagctctgctgctgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggatagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaataggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcagcagcagcgatagcataaacaaccgcaagagaaagggtgcaggcaccgaagaaatcttgccccagctggcaaacagatcaaggcacagttaactgagaactgactagtacagctaaaaccttttctttttcactttactttggcctactgatttgtaacgtagatgttagccctggatttgcaaaacggaacggaatctgtaaactgatactgcttgagtcgaatcgatcgaagtgattctgcaccagatctccctatttcatttatcagaatcgaaagccagctgacagagtcacagtaacagcccgttggacatagcagcaggtgccgaagccaagaacatctgaaactgaccgtcggataacctacgatgggagtagccttttactgcttctaagctttagcctggatacaagttgtcactacagtagtcagtagggcagtaacttggtgcatctccaagagttttcaaaacacactgtcaatctagaaatttttggtgg

SEQ ID NO: 8520 - DNA, 1434 bp, Zea mays
tctccctcctatagttggcttctcgccaccctctgctttcgatcagctttctccgctccccgtttccctctccaactccaatccatggcctccacggatcgctccacgccagcggaggacgagcaacagcagaagcgcccgtctctcttctcgccgtaccagatgccccgcttccgcctcgcccaccgggtggtgctggcgccgatgaccaggtgcagggcgcccgacgcggtcccaggccccgcgctcgcggagtactacgcgcagcggtccacggagggcggcttgctcatctccgagggcaccatcatctcgccgtccggccctgggttccctcgtgtccctggaatatacaatcaagaacagactgatgcatggagaaaggtggttgatgctgttcatgccaagggagctatctttttctgccaactatggcatgtaggccgagcttctcaccaagtatatcaggcgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccataaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggagcagaccgcgtcgcggtccgagtgtccccggccatcgaccatctcgacgcctacgactccaaccccctgcagctcggcctggccgtggtggagcgtctcaacgctctccagcaggaggccgggcggctggcctacctccacgtgacgcagccacggtacacggcgtacgggcagacagagtctggccagcacgggagtgccgaggaggagagccggctgatgcgtgccgtgcgaggtgcctaccgtggcacgttcatgtgcagcggtgggtacacgcgggagctcggggtcgaggccatcgagtccggggacgctgacctggtgtcctacgggcggctgttcatcgctaatcccgacctggtggagcggtttcggcgcgacgccccgctgaacaaatacgtgcgcaagacgttctacacgccggaccctgtcgtcggttacacggactacacattcctcggccagcctaaggcgcgcatgtgattattagtaggttgccgtaattataagaggcggagtgttgtttgtgtgttgtgacttgagaaaacaagcaaacatctgggtaatgccgcgattgttacgtgttcctactgtatacgtgttaccaatattcgggcctacagattgtatctt

SEQ ID NO: 8521 - DNA, 1506 bp, Zea mays
ctccgtcaggtgcccaggtgtagcctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtct

SEQ ID NO: 8522 - DNA, 970 bp, Zea mays
cgaaggagaaagcagaccaacctagccacccagggagaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacaacaccggcgctccgctccgacgctacgagggggccgagtcggaagacgatagcgtccgcgagtacgatgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctggaacgcgaaggaggacgaggaggcgctgcacctgagggtggacatgccaggcctggggaaggagcacgtcaaggtgtgggcggagcagaacagcctggtgatcaagggcgagggcgagaaggaggatagcgaggacgaggccgccccgcctccgagatacagcggtcgcatcgagctcgcgccagaggtttacaggatggacaagatcaaggcggagatgaagaacggcgtgctcaaggtggtcgtgccgaaggtgaaggagcagcagcgcaaggacgtgttccaagtcaacgtcgagtagatgtttccaaatagaagcaagtgccggtacgggatggaggattggaggggcactgccaaactaggattcctctctctcaatctgatctggattctggaatcagatttctcttctttcatttttctcgtctatcttctatcagtatgaaataagcaacgtcgcttcagttttcgtgtcaaggccggtggagtcgcctatgtttattttattttctttgtatttcctacctggacacacgttctct

SEQ ID NO: 8523 - DNA, 1696 bp, Zea mays
ctgacatctcagttgctgaacgcctgaaccgcaagtcatccatgacctcttctattccgaagctgcttctcctcctcttctttctcagccatcgctctcccattgctcgcgcaggcgatgatggcagctacaaggttctgtccatgggctctccgagaactgactccgtctgttcccagtccaaagcggttccttcgtcgtccgccggtgccgccacggtgcccttgcatcaccgtcacggcccatgctcgccgttgccgaccaagaagatgccgacgttggaggagacgctccaccgcgatcagctccgagctgcctacatccagcggaagttctcaggcggcggtggcgctggtggtgacgtccagcgatcggacgccaccgtgccgacggccctgggcacctccctgaacacgctggagtacctgatcaccgtaggcctgggctcgccggccacgtcccagaccatgctcatcgacaccggcagcgacgtgtcgtgggtgcagtgcaagccgtgctcgcagtgccactcccaggcggacccactcttcgaccccagctcgtcgagcacgtactccccgttctcctgcggctccgccgactgcgcgcagctcggccaggaaggcaacggctgctcctccagctcccagtgccagtacattgtcacgtacggcgacggctccagcaccacggggacctacagctccgacacgctcgccctgggctccagcgccgtcaggagcttccagttcgggtgcagcaacgtggagtcgggcttcaacgaccagaccgacgggctcatggggctcggcggcggcgcgcagtcgctggtgtcacagacggcggggacgctcggcagggccttctcgtactgcctcccgccgacaccgagctcctccgggttcctcacgctcggcgctgctggcggtagcggaacctcgggcttcgtcaagacgccgatgctcaggagcagccaggtccccacgttctacggcgtgcgcctccaggccatcagggtgggcgggaggcagctcagcatacccgcctcggtcttctccgctgggacggtcatggactcgggcacggtcatcacgcggctgccgccgaccgcctactcggcgctgtcgtcggcgttcaaggccgggatgaagcagtacccgccggcgcagccgagcggcatcctcgacacctgctttgacttcagcggccagtccagcgtcagcataccgtccgtcgcgctagtcttctccgggggcgccgttgtcagcctcgacgccagcggcatcatcctcagcaactgcctcgccttcgcgggcaacagcgacgacagctccttgggcatcatcggcaacgtgcagcagcggacgttcgaggtgctgtacgacgttggccggggcgtcgtggggttcagggctggggcgtgctgatcgatcgtgatcggcgcaaggacattgacaataccggccgggagtacgtactgtgctcgtttgggttgcgagtgcaacgtaaatggaagaagtgcaaaacatatacatactacttcgattttaattatctttgcgatagcatgcaataacgtcatgcatgcaagtgtgcaaactactaaaagctaaaagataatcttaatgtcacctgattgatgactataaaagattaatgatatattattgtattgcgcttggtgcgatgattaatt

SEQ ID NO: 8524 - DNA, 1153 bp, Zea mays
cgtccgctggctctgcatatcccgcgcccgactcccgttgctgcgtgcggcggcccgactagtcgcgccgcgctgcgcttggcttgattgaaccggccgggatgggggtgttggaagacctcgtggcgagagcgggcgggtgcgcggtcatcgacggcggcttcgccacgcagctagaggcgctcggcgccgacatcaacgacccgctctggagcgccgcttgcctcatcaccaggccgcacctcgtcaaggaggttcatatgcagtatcttgaagctggtgcggacgtcatcatttcatcatcttaccaggcaacaatcccgggtttcatagctagaggaatgtctgtcgctgaggcagaagatttactgcgaacaagtgtaaaactggccaatgaagctcgagatgaattttggaagtcaacactgaggaagtccaaacctatttacaaccgtgctctggttgctgcatccattggtagctacggagcctatcttgctgatggatcggagtacagtggatcatacggtgctgacatcacagccgagaagctgaaggacttccacaggcgccggctgcaggttcttgcaagtgccggtcctgacctgattgcgtttgaggccattcctaaccaaatggaggcacaggcattggttgagcttctggaggaagagaaagtccagatcccttcctggatctgcttcagctccgtggacggtaagaacctgtgctctggggagagttttgcggactgccttaagatcctcaacgcgagcgagaaggtggccgttgtaggcgtgaactgcacacctcctcagttcatcgagggcatcatatgtgaatttaggaagcaaaccaagaaggcgattgcagtttacccgaacagcggcgaagtttgggacgggagagcgaagaggtggctgccggttgagtgcttgggtcacaaaagcttcgacgctctcgcgaagagatggcaggaggcgggggccagcctcatcggagggtgctgccggacaacgccttcaactattagggctgtttccaagatcctcaaaggaaggacggggcattgatttgtttattataattgagctgttgttgcattatgtcactagccagaataacattcagaatatgtatcctgttgctcttc

SEQ ID NO: 8525 - DNA, 854 bp, Zea mays
cactcaacagcaacagctaagcctctcccacaagacagcaacatggctgaggaggaggccaagaaggtggaggtggaggtcaccaaggagcccgaggcggcggcgaaggaggacgtagccgatgacaaggccgtcatccccgcgtccgacccgccgccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatcaaagcttgggaagagaatgagaagacaaaagctgagaacaaggctgctaagaaagtatccgctattctttcatgggaaaacacaaagaaagcaaacatagaagctgaactgaagaagattgaggaacaactggaaaagaagaaggctgaatatgcagagaagatgaagaacaaggttgcaatgatacacaaggaagccgaagagaagcgagcgatggtggaggcaaaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgtttggtggtgtacatgttgaatgcttgacgagaaacattcttgtgtgtagttaagaggtc

SEQ ID NO: 8526 - DNA, 2313 bp, Zea mays
ctaaatttcccaaccttccctttccccttcctcctccagtccaccgcatcaccacaccccgtctccaccccgtacaaatccaaaagagggcgaggagggaaacagatcggctggcggcaatcggtagccggcttggctggcacgatgggcggcgaggccgagggcggggagcggcggctggggcgggtgctgagctttgggatcccggacacggcgctggggctagtgatggggtacgtggaggatccctgggaccgcgacgccatctcgctggtgtgccgacactggtgccgcgtcgacgcgctcagccgcaagcacgtcacggtcgccatggcctactccacaacacccgagcgcctgttccggcgcttcccgtgcctcgagtcactcaagctcaaagcgaagccccgcgcgtccatgttcaacctcatctccgacgactggggcgggtctgcgtcgccttggatccgacagctctcggccaccttccacttcctcaagaagctccacctgcgcaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaaatgatgagtggatccgtgagcttgctacgagcaattctgttcttgagacactgaatttctttctaacagatctcagggcatccccagagtatcttaccctccttgtgcgcaactgtcaacgattgaaaactctgaagattagtgaatgtttcatgcccgatctggtcagtttgttccgaactgcacaaacactacaagagttcgctggtggttcctttgaagagcagggtcaacctgtggcaagtagaaattatgagaactactattttcctccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctttagaggcagttggtacatgcagcaaaaatcttaatgacttccgccttgtcctccttgatagagaagcacatataaccgaattgccactggacaatggggttcgtgctttgcttagaggttgcaccaaactacggaggtttgcattttatgtgagacctggggccctatctgatgttggtcttggctatgttggagaatttagtaagagtattcgttatatgttgcttggtaatgttggtgaatctgataatggaatcatacaattatcaaaaggctgcccaagcttgcaaaaactggaggtgaggggttgtctctttagtgagcatgctttagctttggctgcactacagcttaagtcactgaggtatctgtgggtacaaggattcaggtcatctccaactggaactgatattatggcaatggtacgccccttctggaacattgagtatattgttccagatcaagatgaaccttgcccagagcataagagacagattctggcatactactcccttgctggcaggaggacagattgtcctccatcagtaactctgctttacccggcattttgagtgtagatacttgctttttgccagactgaatctcatggtactaagttccattggtcccactatctgtgaagtaaatggtccctgttcttccaattgatgaggacatgcagacgttccagtgcaaagaaccccaaaggtaagctttaagcaggacggccagctctgaactgaggctagctgagaacaatcatgaatacctgaaggcagcacttatgtcagcttggcctagctgtccagtatgggcatgtaagctttaccatcttttgtagttttggagaaacaattttgcaataactacccttgtttagtgtatattatcgattttcgttcatatgctgttgtattgttgtattgaacaattatgtcaattaattagtctacactctacagtct

SEQ ID NO: 8527 - DNA, 864 bp, Zea mays; identical to SEQ ID NO: 8053

SEQ ID NO: 8528 - DNA, 1053 bp, Zea mays
cagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagctttt

SEQ ID NO: 8529 - DNA, 1677 bp, Arabidopsis thaliana
ctctctgacttaaaacatttattttatcttcttcttgttctctctttctctttctctcatcactatgaagagtttcaacacagaaggacacaaccactccacggcggaatccggcgatgcctacaccgtgtcggacccgacaaagaacgtcgatgaagatggtcgagagaagcgtaccgggacgtggcttacggcgagtgcgcatattatcacggcggtgataggctccggagtgttgtctttagcatgggctatagctcagcttggttggatcgcagggacatcgatcttactcattttctcgttcattacttacttcacctccaccatgcttgccgattgctaccgtgcgccggatcccgtcaccggaaaacggaattacacttacatggacgttgttcgatcttacctcggtggtaggaaagtgcagctctgtggagtggcacaatatgggaatctgattggggtcactgttggttacaccatcactgcttctattagtttggtagcggtagggaaatcgaactgcttccacgataaagggcacactgcggattgtactatatcgaattatccgtatatggcggtttttggcattattcaggttattcttagccagatcccaaatttccacaagctctcttttctttccattatggccgcggtcatgtcctttacttatgcaactattggaatcggtctagccatcgcaaccgtcgcaggtgggaaagtgggtaagacgagtatgacgggcacagcggttggagtagatgtaaccgcagctcaaaagatatggagatcgtttcaagcggttggggacatagcgttcgcctatgcttatgccacggttctcatcgagattcaggatacactaagatctagcccagctgagaacaaagccatgaaaagagcaagtcttgtgggagtatcaaccaccacttttttctacatcttatgtggatgcatcggctatgctgcatttggaaacaatgcccctggagatttcctcacagatttcgggtttttcgagcccttttggctcattgactttgcaaacgcttgcatcgctgtccaccttattggtgcctatcaggtgttcgcgcagccgatattccagtttgttgagaaaaaatgcaacagaaactatccagacaacaagttcatcacttctgaatattcagtaaacgtacctttccttggaaaattcaacattagcctcttcagattggtgtggaggacagcttatgtggttataaccactgttgtagctatgatattccctttcttcaacgcgatcttaggtcttatcggagcagcttccttctggcctttaacggtttatttccctgtggagatgcacattgcacaaaccaagattaagaagtactctgctagatggattgcgctgaaaacgatgtgctatgtttgcttgatcgtctcgctcttagctgcagccggatccatcgcaggacttataagtagtgtcaaaacctacaagcccttccggactatgcatgagtgagtttgagatcctcaagagagtcaaaaatatatgtagtagtttggtctttctgttaaactatctggtgtctaaatccaatgagaatgctttattgctaaaacttcatgaatctctctgtatctacatctttcaatctaatacatatgagctcttcc

SEQ ID NO: 8530 - DNA, 1564 bp, Arabidopsis thaliana
ctcttagagctcaataagagaagatggatgttccacggccagctttcaaatgttttgatgacgatggccggcttaaacgttcagggacggtttggaccgcgagtgcgcatatcataaccgccgtgattggatctggtgttctatcgcttgcgtgggctataggtcaactcggttggatcgcaggtcctacagtgatgttgttgttctcttttgtcacttactactcttccacgcttcttagcgactgctacagaaccggagatcctgtctctgggaagagaaactatacttacatggacgctgtccgatcaatcctaggtggctttaggttcaagatttgtgggctgattcagtatttgaatctgtttggtatcacggtcgggtacacaatcgcagcatctataagtatgatggcgatcaagaggtccaactgtttccacgagagcggagggaaaaacccgtgtcacatgtcgagcaatccatacatgatcatgtttggtgtgaccgagatcttgctctctcagatcaaagattttgaccagatttggtggctctccattgtcgctgctatcatgtccttcacatactctgcaatcggtttagctctcggaatcattcaagtcgcggcaaatggagttgtcaagggaagtctcaccggaattagcatcggcgcagtgactcagacccaaaaaatatggagaacctttcaagcacttggagacattgcctttgcttattcatactctgttgttcttattgaaattcaggacactgtaagatctccaccagcagaatcaaaaacgatgaagatcgccacaagaatcagcatcgctgttacaacgacattttacatgctatgtggttgtatgggctatgccgccttcggagataaagcaccgggaaacctcttaaccggttttggtttctacaatccgttttggctccttgacgtggctaacgctgccatagttatccaccttgtaggagcttatcaagtctttgctcagcccatcttcgcctttattgagaaacaagctgccgctaggtttcccgacagtgacttggtgaccaaggaatacgaaatccgaatccctggttttaggtcaccgtacaaagtcaacgttttcagagcagtttaccgaagcgggtttgtggttttgaccactgtgatatccatgcttatgccgtttttcaacgacgtcgtagggattttaggtgcgttagggttttggcctttgacggtttactttccggtggagatgtatataagacagaggaaggttgagagatggagtatgaagtgggtttgtctgcagatgttgagctgtggttgtttgatgatcacgttggtcgccggagttggctccatcgccggagtaatgctagaccttaaggtttacaagccgttcaagactacttactaaacaaaccatgatgatgatgaagaagaagaaggtggtggagaaaaaaacaaaagatataaattttaatatatttcatttggggaaatgtgaataatgtaaaagttcttcgtttcgtataatttttatcttgcgtaaaaaaa

SEQ ID NO: 8531 - DNA, 798 bp, Zea mays
cccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttg

SEQ ID NO: 8532 - DNA, 1245 bp, Zea mays
cttgtccctcggcatcgcgcagactgttgcaaacggtgggttcaagggaagcctcaccggcatcagcatcggcgccgacgtcacctccacgcagaaagtgtggcacagcctgcaggccttcggcgacatcgcgttcgcctactccttctccaacatcctcatcgagatccaagacacgatcaaggcgccgccgccgtcggagtcgaaggtgatgcagaaggcgacgcggctgagcgtggcgacgacgaccatcttctacatgctgtgcgggtgcatggggtacgcggcgttcggcgacaaggcgccggacaacctgctgacggggttcggcttcttcgagccattctggctgatcgacgtggccaacgtggccatcgtggtgcacctggtgggcgcgtaccaggtgttctgccagcccatcttcgccttcgtggagcggcgcgccgccgcggcctggcccgacagcgccttcgtcgcgcgggagctccgcgtggggcccctcgccctcagcgtgttccgcctcacgtggcggtcggcgttcgtgtgcgccaccaccgtggtggccatgctgctccccttcttcggcaacgtggtggggttcctcggcgccgtctccttctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggctgtgctggggcctggactggcctgggtttggacgtatgtgcatgcagcattcattgcggtgcgttcaactgtggtcaacaagggagggagacggatgcagatgtttgcatggaggcccctatagaacaagtgaaaggtttaggcgcccttgtgcacatgctggtcgcattccttgcaagaataccaggggtggggccagaatggcatgagctgggtgtttgttgtgatgacgagtctactgtaggtgtatgaagcagcaacaaaaaacatgttcctttctaactcttcttcttcttcttctattcttcttctttatttacaattttcttttatgtgttttcgtctaattaaggttctggttttgtagttctaccgtgcaactcattgtaccggaaaagaatatatgaacaggaaatcccat

SEQ ID NO: 8533 - DNA, 1935 bp, Zea mays
caggatcctctgcgccacccacaaccgtgtgaccgtccgtgctgccggcgacccctatccgccgacccgtccgtcccaccacaccccaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgagaccgagctcgcccgcatctgcgacggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggttggaccatggtgtacatgttgataggatgaaggtgtacatatcttattaattgtgattcatagtttctggggttttttttggggggtttgtaggacattgctcttgcagatctggctccaacccaccccatcaggcttggccttgctctcaacttctcagtgttctactacgagatcctgaactcccctgatcgcgcctgcaaccttgcaaaacaggtttgcttcttctccttctatccccactttgtgatttgctttcattttgagaccctttgtgatttgttttaattttgagacatgatgtctcctagattgtgtgtagcttctgggcaatggattgagtgtgcataaacagctcctgtctccatcagcttatgtaggggtttggttgattcaattaaaaaaaagatggtgcaaaggaaatagttcacttgcctccatctgcatgcctattcactgaaacatttttttcttacattaggcactgtgtaagtgatggatctaattactctgggtgctaacaaaatgcttcttttgctaccacccacggaggctgttgtttttttcactcaatctgtcatgtcttcttgcatacatgttctactacatattgaacattgacaagctacaacctaatgattacaagtcacctagagaattctcaatttgtcctaaggattacaagtcacatagagaattctcagttttccttctatgatgattacaagtcacctagagaattctcaatttcccttgtatgatggttgaactgtctaacttgtctgcaatccatgaagttggacatgacggtcttcatacagtacttgagatgacagatgcattccctatgcaacgaagtactcttgacgttccccatcaatttaagcatcttgggctttatattggatgcagttggcttgaagtaaatttaatctttgttgcaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgctgccccgaaagaatctgcggagggtcagtaagatggattcagtctcacgacctgctgctgctgatgttgaggagtgaccagaaccagaaccgtcgtcctcgattctgatagattatcttctagtataccttgtgttgtcgttgtcgtcggcgcgacgatcgtcgtcgtcgtcgcgccggtgtatgcgatgaagctgccattgctgctgttttaattaagcattctagatgttataccgc

SEQ ID NO: 8534 - DNA, 710 bp, Zea mays
gcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttttggagctggccgggaacgctagcaaggatctgaaggtgaagcgtatcacccctcgccacctacagttggccattcgcggagacgaggagctggacaccctcatcaagggcaccatcgcaggtggaggcgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacactgtttgtgttgagttgttaacttcaagggtgcaaacctggataattatttagttattatatgactatctggtatccggttt

SEQ ID NO: 8535 - DNA, 2276 bp, Zea mays
cgacttccccatcatctacgtcaaccgcgggttcgagagctccactggatacagcgccgaggaggtgcttgggaggaactgccggttcctacaatgcagaggaccatttgctcagaggaggcatccccttgttgatgcagcagttgttactaggattcggagatgtttagatgaagggactgaatttcatggtgatctgttaaattttagaaaagattgttctccatacatggccaggctgcaattaacacccatatacggagacgatgaagtaataacacactatatgggcattcagtttttcaatgattctaatgttgacttggggccatcttctggctctgtgacaaaggaacttgcaagatctacatggattgcacctggcaacactgactcaccaactccagtaggcaagggtaatttgtgggaacattctagtctctttctgctgagtgatgaggtaatttgccagaagatcttgtccaaactgtcgcccagggatatagcatcagtaaactctgtttgcaagcgacttcatcacatgacaaggaatgaagacctttggaggatggtttgtcagaatgcatggggcactgaagctactcgggcccttgagactgtggcaggatcaagaagtttggcatggggccggctagcacgagagttaaccacccttgaagctgttgcctggaggaaattgacagtcggtggtgcagttgagccatctcgctgcaacttcagtgcctgtgccgtagggaaccgtgttgttctatttggtggagagggtgttaacatgcagccgatgaatgatacatttgtgctggacttgagtgccagcaagccagaatggaggcacatcaacgtgagcgcagctcctcctggtcgctggggccataccctgtcatgcctgaatggatcacggctgattctgtttggtggctgtggggggcagggtctgcttaatgacgtcttcattttggatcttgatgcacagcatccaacttggcgtgagattcctggccttgcaccccctgtaccacggtcatggcatagctcctgcactgttgatggaaccaagctggtggtttctggtggatgtgcggactctggtgttcttctcagcgatacctacctcctagatgtgacaatggaaagacctgtttggagggagatacctgcatcttggtctccaccttcaaggctggggcactcgctatctgtctatgatggcaggaaaatcctgatgtttggtggccttgctaaaagtggtcctctacgacttagatctagtgatgtgttcactctagatttaagtgaagacaagccttgctggcggtgcataactggcagcaggatgccaggagctggtaatcctgctggggtcggcccaccacctcgcctcgaccatgttgtcgtgagccttcctggtgggagagttctgatatttggtggttctgtggcgggtcttcactctgcttcaaaactttacctcctggatccaacggaagataagccaacctggaggcttctgaatgttccagggcatcctccacggttcgcctggggccacagtacttgtgttgtcggagggacaaaggcaatagttcttggaggacaaactggagaagagtggacgctaactgaaatacacgagctttctctagcaagctcattagtctgaagatgggaaggtcccagcaagctttccagcttccttgaagcaatgtctctggagacagctacctgttcatatgacttgaggcagattttttttccaacagtggtgtgcaagcacaagcacaaaagggttggtgaagtggacaaccagacctgattacttgtgccatgcctgggagtcagctggtctaaaagtaggaataagttacctctgctgctgctgttcgtatgatctgaaatgatggaatagctggcatccataagctaatctcagttcttatcatgtttcaaatgggacactggcattatgtcgctggagcccctgatgcaacaggtaccctgccttctggttgcgcctgccttcggtgacaactgatgctgtggtcttctgttttttgacccatcaactgctgtgaagcttctttgttatgcttttgcgccacttcgtgcttactcaattgctgctttctggagaagctgtaacacagacacacctgctgtatttaattttgcctttcgtatcactttgtgcttacctcagctgttagtgatacctataacattttctttttaatctgattatcaaaggatgaattatg

SEQ ID NO: 8536 - DNA, 759 bp, Zea mays
ccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaatatcaagaatgacttcacccctgaggaggaagaggagatccgcagggagaaccagtgggccttcgagtaaggaggtgctggatctattgatgcctaagtttggtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccct

SEQ ID NO: 8537 - DNA, 923 bp, Zea mays
ggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagatacctcgctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcacccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagcccggtctggttgggttgggaagccctttaaactgttgtcacttgcattttaccttt

SEQ ID NO: 8538 - DNA, 1437 bp, Zea mays
cgtccgcccagccgaagggaagcctcagcagatcaatcgccccatcacgcgaagcttcggcgctcagctcgtgaagaacgtgcaggcgaatgccgcaatcaagaatgccgcaatcctacccgcgaggcatgcgccgaggcaggaaaggaaggctcctgccaagcagccgcctcctgaggatgtcatagtactcagctccgactctgaacagagcaggacgcagttggagagcagcgctagctccgtccgctcgaggaagaaggtcatcaacaccctttcatctgtgctctcggctcgctcaaaggctgcctgtggaatcactgataagagacggcaagtagtagtgatcgaagacatcgacaagttggacgtcaacaatgagctcgcagttgtggaatacattgaggacatctacacgttctacaagattgctcagcatgacagacggccatgtgattatatagacacccaagtcgagatcaaccctaagatgagggctatcctggctggttggataattgaagtacaccacaagttcgagctgatgccggaaactctctacttgaccatgtacatcatcgatcagtacctctcgctgcaaccagtcctgcgaagggagctgcagctggtcggtgtttcagctatgctgatcgcctgcaagtacgaggagatttgggccccagaggtgaacgatttcattcttatatcagacagtgcatacagcagggagcagatcctttcgatggagaagggaatcctgaatagcctggagtggaacctcactgtccctacagtatacatgttccttgttcgttttctgaaggcggcaaccttgggcaacaaagttgagaaagagatggagaatatggtcttcttcttcgctgaactggcgctgatgcagtacggcttggtgacgcggctgccttcgctggtcgctgcttcggttgtctacgcagccaggctcactctcaagagggctcccctctggaccgacaccctcaagcaccacacgggcttcagagagtcagaggcagagctaatcgagtgcacgaagatgctggtcagcgcacactcgtcgtccgccgctgacagcaagctgagggctgtatacaagaagtattccagcgagcagttcggaggggtcgcgcttcgcccacccgcagccgcagtggagatcaagtaaacgaagataacttcgtgctagtgtttgttagtataatgtaatggaaggcgagcctgacattcgctaggttttatgtttgcttgtgggggtagtcaagaaagtttgaatgcttgagacagccgtttgtttggtaggctgttctcagagtccaggtgttatgtgacttgtgatggcatgttgtgtttcatgtgatggatatcatcagaatcctgtctagtacgatatctattcatgaatataaatggtatttattc

SEQ ID NO: 8539 - DNA, 882 bp, Zea mays
taccgcatacgtttcacccttcctctccccactccgaaccctagccaccgtgctcacttcccagctcgaacccgccgcgggcgagtccacggcagtgcaggacctgatcctgcggtctaggccgcggcggtgagatggtgatggtgtcaggcggcggagggaacgcgtgggcgaaggagatgaccctccgccgcaggatagccagcatattcaacaagacgcaggaacacttccctactctgaaggactacaacgattatctggaagaagttgaggacatgactttcaacctgatcgaagggatagatgtcgaggagattgaagcgaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgtttttgggggagtggctcagcctcgccccacaggtatggcgccccaactaatcggcagtgggtcggatcctctgcaaggagacgacgaggagaccaggagactacgcgcagagcgagcagcacgggctggcggatggactgctgaattgagcaagagaagagcgcttgaggaggcgtttagcgccatattcatctaggattagatcaaaaagcaacacatggcctggaggaaagccggcatacttaaaatggctgtcaaactacaaagcgttggatgatctgtgccgtaattatctttgggacatggaattctcacaaactgtggtgaagcaccctttgtgtgcctttggttgcaaaagc

SEQ ID NO: 8540 - DNA, 1247 bp, Zea mays
cgcccacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctcggcgacgacgagttcggccgcatgctcgccgccatcctccgcgacaacggcgtcgacgacggcggcgtcgtcttcgactccggcgcgcgcaccgcgctcgccttcgtcaccctgcgcgccgacggggagcgcgagttcatgttctaccgcaaccccagcgctgacatgctcctcaccgccgacgagctcaacgtcgagctcatcaagagggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccagggatttccatggcgctgtgccttccttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaagggggcgatcccgtcgctgcccaccgaagcggaggtcttgcagctaatagagaaggcttagatcatcatcgtcctgtacgccatggttttcaccagcttctacttcttcgaattgtattggattctgatatggaacagaagaagaagcggctgccccatcttaccagccctttttgtttgccctagtttccccttgtgaaaagggtgttttgttttataaactctacttgcaataagcagagcctttttttaatt

SEQ ID NO: 8541 - DNA, 1680 bp, Zea mays
gctcctggctcgcggctcagcttgccactaccagcaagcgctcgtcacccgtcggttctccccgagtagctcgtcgcgtcggcaatggagaatctgagatctcaaaactgccaccaaggtgttgccatggagggagtcaagtttgcgccggagaaggccaacaccaaccggagagccctcagcgacatcaagaacataataggaggcccacaccagcacttggcggtcagcaagagggctctgtcagaaaaaccagctgctgctgctgctgcaaatgctaaagatcaagctggctttgttggacaccgtccagtcaccaggaaattcgctgcaacattggcaacccaacctacagttgcccttctggacccaattggaagtgaaagactgaaaagaaacgctgatacggcatttcacacacctgcagatatggaaagcacaaaaatgacagatgacagtcccttgcctatggtgtcggagatggatgaaatgatgagtcctgaactgaaagagatcgagatggaagatattgaggaggcagcacctgatattgacagtggtgatgcaggaaattctctggctgtggctgactatgtagatgaaatttacagattttacaggaaaactgagggtgcaagctgcgtccctacaaattatatgtcaagccaaactgatataaatgagaagatgcgtggcattctaattgactggctcatagaggtacactacaaactagagctgttggaggagacccttttcctaaccgtgaacatcatagacagattcttggcacgtgaaaatgtggtgcggaagaagcttcagttagctggtgtaactgctatgttgctcgcgtgcaagtatgaagaagtgagcgtacctgtggtcgaggatctgatcttgatcggtgatcgtgcatacacaagggctgacattcttgagatggagaggaggatagtgaacacacttaatttcaatatgtcggtgccgactccatactgtttcatgagaaggtttctaaaggcagcacaatcagagaagaagctcgaactcctgtctttcttcatgatcgagttgagtcttgtcgaatatgagatgctccagttctgcccgtctatgctagcagccgctgccatctacaccgctcaatgcaccataaatgggttcaagtcctggaacaaatgctgtgaactgcacacaagatattcagaagaacatctaatggtttgctctaggatgatggttgaactgcaccaaagagcagctcatgggaaacttacaggggtccatagaaagtacaacacttctagatatagctatgctgcgaaatcggaacccgcaactttcttgctggatgcctgaacctaagcttgaactatacacactcttaactacttccatggaaagagtggaagggaggctgcttcgactaaactacagaagtgggatctatctgaatatatgcaacggctgttgcagcaaatatttggtggggctgggttggtgtgttgtttgttagttcaataacttaacattaatgaaacagtgtttgtgttgtttaggttttttttccaattatatcgattggaatttcatttgttgtatcctggccatcattctttactcatgtcatgtgacacctctgcgttttgaaaaataaacattgattatgtggatctgctg

SEQ ID NO: 8542 - DNA, 1087 bp, Zea mays
gcaggcctatcgtacctacgaggctacgaccatatcccagcccatttcggcctgctactcccgaacttccatatctctcgtctgcttctcactctcctcccacccactccagaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggcatgggtggaatgggcggtatgggtggtatgggaatggatgattttgaggatgatagtgatgaagaagaagtgtcgaaacctcaagctgccggacatgctgctgaggccgagaagactgagtcggcggaagccaagactgagtcggctcagagcagctgaagatgcttccgacatgatctaaactagttgtatcgtcaagttaattctgctgaatcggtggacaaacttctacgttgtggcactggccgatcccagtgacttgccctaaaatttacgttctgtctttacatgggcatcctagtgttatgctcatcacattattgatattgtttctgtgatgcttcctttggtcgacaatcatgtgctggagtttggtttactggattgcttttcttctgtggttttttggctttatacctgtatggaaagctggagccgcaaatggagaaatagggacgacgtgt

SEQ ID NO: 8543 - DNA, 1722 bp, Zea mays
catgaccccatttcatttctctacctctccagctgcccacttctctgtgagcgcgcgcgagtgtggagagaagggagggaattcccccctttctgttcggcgcacgcacccgcacgccccacgctgcacagtgcacgccgccttttcctccgccttgctgctgcgagtccgcaaccactggaggaaaaatcttttccttcacttttcttccctttccccccgcgcatgcacgggctctgattgacgccatgggggacgccgcggcctccacgtccgctcccaccacgcccacctccatcctcatctgcctggaagacggcagcgaccttctcgccgatgccgacgatggcgccggcactgacctcgttgtcgcccgcgacgaacgtctgcttgtcgtggaccaggacgaggagtatgtagcgctgctcctgtccaaggagagcgcgtcaggcggcggcggcccggtggaggaaatggaggactggatgaaggccgcgcgctccggatgcgtccgctggatcatcaagaccacggcgatgttccggttcggcgggaagaccgcttacgtcgcggtgaattacctcgatcgcttcctggcgcaacggcgagtcaatagggagcatgcgtggggtctgcagctgctcatggtggcgtgcatgtcgctggcgaccaagctggaggagcaccacgctccgcggctgtcggagttcccgctggacgcgtgcgagttcgcgttcgaccgcgcgtccgtgctgcggatggagctcctcgtcctgggcaccctcgagtggcggatggtcgccgtcacccccttcccctacatcagctgcttcgcggcgcggttccggcaggacgagcgccgggctgtcctcgtgcgcgccgtggagtgcgtcttcgcggcgatcagagcgatgagctcggtggagtaccagccgtcgaccatcgccgtagcatccatcctcgtcgctcgcggcagggagacgcccgccggcaatctggacgcgctcaaggcgatcctgggctcatcatttccgcagctagacaccgggcatgtgtactcctgctacagcgcaatgattcgggaggacgacaagtcgccgacgcagtcgacgtcgacgtcgacgggggtggcgtcctcgggcgtctctgtcgccgcgcacgccggggggagcgggagtcccagccccccgggcgcttccgtgtccgtgggcgccaataatgccgctggcaccgccccgccggcaaccacggacaaccgcaacaagaggagacggttgcgctcacctcagcgacagtaggagcagctcagctgctggcagtgcattgcagtgcagtgcagtccagctgcgttttcttttttcagctcaccatttccttttgctgccgattgtttcttcaggggtggccgtagagtgatttggtaatttagtgccggaaagattagtgcggtgtcgcagagtgatttggtaatttagtgccggaaagatttctttgttttgaggagatctttcgcgggaccaaagggaggggggcagtgtaaagacgacagaacaagcgtgaaggcctcgagagtcgagacctcacagggtaccgcctagcgcctactggggtgaaagtgaagtcaaggagtcgggagggtgtgtgtgaataccgtttgtagcagctagtgcgtccgtctgtcttttttttttctttctgtttattaattattaatagcctgct

SEQ ID NO: 8544 - DNA, 805 bp, Zea mays
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagg

SEQ ID NO: 8545 - DNA, 1056 bp, Zea mays
gccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatctatttctctagatatccctaccatgatgatggcccgccgtctgtttttattctaaaaa

SEQ ID NO: 8546 - DNA, 1498 bp, Zea mays
cgtgacttcccctccccttctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggaggtttccccgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaaccaaacggctctatggtgatgtatgcaaaaagttgctttcgaacttgatttctcc

SEQ ID NO: 8547 - DNA, 783 bp, Zea mays
ttgttgtgcttctcgtttcaccgtgcgccacaagcacacaactagggcgaccgccgccgacctacggccagctgtgcccatgtcttcgtcgggccctttgctggcgacgggaacccaccacaccggccgccaacctgaggttttgtgggctcagcgctccgagaagattttcttgactatctcattgccagatgcgaaagatgttgtgttaaagaccgatcctaagggcctctttaacttctctgctgttgtccatggggaaccttttagcttcactttggagctttttgattcaatactgtcagagggaagtaaaacgaagacaaagatgggcctgcgaaacataatctgctcaatccagaaagaaaagaaaggttggtggaagcgcttgctaaagtcagaggaaaagcatccatacatcaaagttgactggaacaaatggtgcgatgaggatgaagagtctgagttctctggggattcagatggtggctttgatgaggcaaatgaaggagatgaaagtgatgatgatgatgggatgctttatctccccgaccttgaaaagctaaggggcaagtgatctggctgcttcggtgaagggagtagggttgatgtaacaagttaccgttgacgtgacagagtaggcttatcatcgacgtagttggggtcttacttgctgagcatctgcgacggcttgagacttttaggcatgtcttctatctccgaagcactctttcggtctttcctgatcagtgagctagcgctctgaaaacgtagcgatgagct

SEQ ID NO: 8548 - DNA, 697 bp, Zea mays
ctccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgtccttgtgtcttattgtatgttcgtcttcatcgagaagatcttcagcaatcagagctcgttgtgtact

SEQ ID NO: 8549 - DNA, 2168 bp, Zea mays
cttggctggcacgatgggcggcgaggccgagggcggggagcggcggctggggcgggtgctgagctttgggatcccggacacggcgctggggctagtgatggggtacgtggaggatccctgggaccgcgacgccatctcgctggtgtgccgacactggtgccgcgtcgacgcgctcagccgcaagcacgtcacggtcgccatggcctactccacaacacccgagcgcctgttccggcgcttcccgtgcctcgagtcactcaagctcaaagcgaagccccgcgcgtccatgttcaacctcatctccgacgactggggcgggtctgcgtcgccttggatccgacagctctcggccaccttccacttcctcaagaagctccacctgcgcaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaaatgatgagtggatccgtgagcttgctacgagcaattcttttcttgagacactgaatttctttctaacagatctcagggcatccccagagtatcttaccctccttgtgcgcaactgtcaacgattgaaaactctgaagattagtgaatgtttcatgcccgatctggtcagtttgttccgaactgcacaaacactacaagagttcgctggtggttcctttgaagagcagggtcaacctgtggcaagtagaaattatgagaactactattttcctccttcactgcaccacttgagtttgctctacatgggaacaaatgatatgcaaatactgtttccatatgctactgcacttaagaagttagaccttcagtttacattcctttccacagaggatcattgtcagatagttcaacgctgctccaatctggaaaccttagaggtgagggatgtcataggggatcgtggactacaagttgttgcacagacctgcaagaaattgcataggctcagagtagagagaggagatgatgatcaaggaggtcttgaggatgaacaaggtaggatttcacaggtggggttgatggctatagcccaaggctgccctgagttgacatactgggcgatacatgtatcagacattacaaatgcagctttagaggcagttggtacatgcagcaaaaatcttaatgacttccgccttgtcctccttgatagagaagcacatataaccgaattgccactggacaatggggttcgtgctttgcttagaggttgcaccaaactacggaggtttgcattttatgtgagacctggggccctatctgatgttggtcttggctatgttggagaatttagtaagagtattcgttatatgttgcttggtaatgttggtgaatctgataatggaatcatacaattatcaaaaggctgcccaagcttgcaaaaactggaggtgaggggttgtctctttagtgagcatgctttagctttggctgcactacagcttaagtcactgaggtatctgtgggtacaaggattcaggtcatctccaactggaactgatattatggcaatggtacgccccttctggaacattgagtatattgttccagatcaagatgaaccttgcccagagcataagagacagattctggcatactactcccttgctggcaggaggacagattgtcctccatcagtaactctgctttacccggcattttgagtgtagatacttgctttttgccagactgaatctcatggtactaagttccattggtcccactatctgtgaagtaaatggtccctgttcttccaattgatgaggacatgcagacgttccagtgcaaagaaccccaaaggtaagctttaagcaggacggccagctctgaactgaggctagctgagaacaatcatgaatacctgaaggcagcacttatgtcagcttggcctagctgtccagtatgggcatgtaagctttaccatcttttgtagttttggagaaacaattttgcaataactacccttgtttagtgtatattatcgattttcgttcatatgctgttgtattgttgtattgaacaattatgtcaattaattagtct

SEQ ID NO: 8550 - DNA, 842 bp, Zea mays
ctcaagtgctcagtgctcaccgctctgcccctgcctcatcacacgcgcgcacggcgcacagataccttttctctcctctcccgtcccactctcctgggcaatcccggcccggcatggcgagcccgtcctcgtccccctcgcggaaggctctgagcaagatcgcctgcagccgcctgcagaaggagctcgcggagtggcaggtcaacccgcccgcgggcttcaagcacagggtcaccgacgacctccagaggtgggtcatcgatgtagcgggggcagcaggcacgctctacactggcgaaacctacaagttgcaggtggatttccccgagcattatccgatggaggcacctcaggttatatttctgcatccagcaccgatgcatccacacatttacagcaatggacacatctgtttagatatactgtatgactcgtggtccccagcgatgactgtcagttctatctgtatcagcatattatctatgctgtccagctcgccagaaaagcaacgcccagctgataatgatcgctatgtcaagaactgtcgcaatgggaggtctccgaaagagaccaggtggtggttccatgatgacaccgtgtgatcggtgttccgattattgttgtcctgtatgcatttagttgccagactatgggagatggacttatttcgaacgacccatttgaccagaaattaacatgctcttgtggtttgtagatgaatgtgcatcagcgtcaggcctgtactttctgattcttacaccgtcgatgatatatagaataatgtttgtatcttgtcaatttacggaacagacatgaaattcaatgcaggtcactggtttctg

SEQ ID NO: 8551 - DNA, 1641 bp, Zea mays
cactgagactgagaccgacaaaagtgtatgaattatgccagaagtgtttcgatcgagtagtggatttagacgacggattacgtggcatgcatgagcatctgatgacaagttgacaactaggctgagatcgccatcttcttggttggtcggaaatgagctcgacaggttgaggttgtcagccagcgagatatctgatctcctccggctccggtgcggtgaggaccccatcccgccggcggacaaaagttacatggcctgccccccgcccgaacaggaagagggcccacacgtcggccactctgtctgaccacagcacccccaccacctagctttattcccaaaacgttttcccctggaaagagaaaaacggagattccttgcccccttttcccttccccatcgtcgaaaccctagccccgcctcgccgccggcacgccggatcggtcggcgccatgtccaaggccagggtctacgccgacgtcaacgtgctgcgccccaaggagtactgggattacgaggcgctcaccgttcaatggggtgagcaggatgactatgaagttgtcaggaaggtcgggagaggaaaatacagtgaagtatttgaaggtattaatgttaacaataatgagaaatgcatcatcaagatcctcaagcctgtgaagaaaaagaagatcaaaagagaaattaaaattcttcagaatctttgtggaggccctaacattgtgaagctgctcgatattgttagagatcagcattcgaaaacgcccagcttgatctttgaatatgttaacaacacagatttcaaagtgctgtacccaacattaacagattatgacattcggtattacatctacgagttactcaaggcattagattactgccattcacaaggtattatgcaccgagatgtgaagccccacaatgttatgatagatcatgagcttcggaaactccggctgatagactggggtcttgctgaattctatcatcctggcaaggaatataatgtccgtgttgcatccaggtacttcaaggggcctgagcttcttgttgacttgcaagattatgattactctttggacatgtggagtctgggctgcatgtttgctgggatgatttttcgtaaggaaccatttttctacgggcatgacaaccatgatcaacttgttaagatagccaaggtacttgggacagatgggctgaatgtttatttgaacaagtacagaattgagcttgaccctcagcttgaagccctcgttggaaggcatagcaggaaaccctggttaaagtttatgaacgcagataaccagcacctagtgtctcctgaggccatagatttccttgacaagcttttgcgttatgatcatcaggagaggcttactgcacttgaagctatgacgcacccgtacttccaacaagtgagagccgctgagaacagcaggacgcgagcgtgacaggcaaagagcgaagaccatctgctcttttatcagtcagtcaggttgtatgagatgagtagccgttgggtcacttggcagaaaataaacaatagcggtagagcctgtactgtacgtaacgtaacctcctcgaggagttgtgaggtttgggacgtgattgcgaacatggtatattaatgattgttcatgt

SEQ ID NO: 8552 - DNA, 1100 bp, Zea mays
gccgcctctggtccacatctctctacgccgccgccccgccgtccaccgataccgcagcgctgggaaggatcacgggggagcggagcgaggcgggggacccgcggttttgtcgcccggatggcggcggagcgatgacactggcggcgggtgcggcgcggcgttgggatgcggacgatctgcgatgtgtgcgagagcgcaccggcggtgctcttctgtgcggccgacgaggctgcgctttgccggccttgcgacgagaaggtacacatgtgcaacaagcttgctagtcggcatgtgagagttgggcttgcagaccctaataaactggcacgttgtgatatatgcgagaattcacctgctttcttctactgtgagatagatggcacctcactttgcctgagctgtgatatgactgttcatgttggtggcaaaagaacccatggtagatacctgctcctaaggcaaagggttgaatttccaggagataaaccgggccatatggatgacgtgcctatggagatcaaagatcctgaaaaccagagagagcaaaacacgcccaaggagcaaatggcaaaccaccataacgtcaatgatccagtctctgatggcaattgcgatggccagggtaacattgattcgaaaatgatcgatcttaatatgcgcccggctcgtactcatgggcaaggatcaaattcccagactcagggggtggatcttagtgtgaacaaccatgactctccaggggtggtgccaacaagtaattccgaaagagacgccatcaagtaaacattggaagattggaatgtacatttcaactacatattctgttctataggagctcctgggggcagaaatggggttattcagtggtctctctgttatcactagtaagcgtatttctggcagagttggagctaataactgcatctcaattcggcttgtcgtgccctagacggtattgctgtccaattgcattctctttgcgattgttagaactctgtatagaagcgcagcggctgccgcctgtgctctggagccggagtattgtgtgccattagaaactgtacaaaagattaatagaccgctcatttttctctggtcgc

SEQ ID NO: 8553 - DNA, 1064 bp, Zea mays
cagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcctgccgtactcgcgctgtgttgggaaaaattggttttcgttc

SEQ ID NO: 8554 - DNA, 1046 bp, Zea mays
cgcacgcacgaggccaccaccacgaccacgagcgcgcgcttgccacggcagaccaccccgcccagcggccagcttgctcgccacgaccacgatgggcttccccgtggggtactcggagtcggagatgctgctcccgcgcgtgctgctgcaggtgctcctcctcctcggccacttccaccgcttcctcctctgggccttccacgccgtggggctcggcgacctgatcgacctcggctgcaactacccgccgccctccgcgtccacggcgcaggagatgatggagcaccaggggcgcgacgacgtggcctccccgctgcagcaccagcggacggagttcaggcccgtcgcggcggcgctcatcgaggaggcgctccccgtggtgcggttcgacgagctgggcggcgcggcgtgcgggagcggcgactgcgcggtgtgcctgggcggcatcggcggcggcgacgaggtgcggcggctcggcaactgccgccacgccttccaccgggcctgcctggaccgctggatggcgcacgaccagcgcacctgcccgctctgccgcgcgccgctcatcccctgggccgccgacgccgacgccgacgcggccgactacgacatgtcctatccgtctcccctgccgcccacgcagctgcggcgggctcacgagctgctgctgctgcttaccggcctgggcggcttccagtgatgcgcctgcgcgtgcgtgcgtggctggcacttgggcaggccggccacgcgaatccgatccgtggcgtggcaaaccgcgtgctcatgtgcggcccagcacgcccggtcggtcagacgggtgaccgccgccaaacctgctcagttgccagccgtacacgcttggcctcgtcttcggtcgtgtctccgactccgttggtttttttacagaggctcccagtcccaggtcaaacaaaaaaggaggcgaaacagacaaagcagtcggaaattaggcaggtactgtactaggttgatctgtaggccgattgggcgactccaaatctgtggagctgtgaatcctttggcagatt

SEQ ID NO: 8555 - DNA, 2684 bp, Zea mays
tcactggtgtgggccgtggctgtacgccgcagagtgaagcgagacgagacgacgatgcgcaagtgggcgctctcctccgcgctcctccttctcttcctcctcaccaccctccccgacccagctaagaagctacaggtgaatgcggaagagagcagcgatgacttagctaacccacccaaggtagaggagaagcttggtgctgtccctcatggcctgtccaccgactctgaggttgcccagagggaagctgagtctatctctaggaagactcttaggagctccgccgagaagtttgagttccaggctgaggtgtccagactcatggacatcatcatcaactcactctacagcaacaaggatatcttcctgagggagctcatatccaatgcctctgatgcattggataagatcaggttcctttcccttactgataaggaagttctgggtgaaggtgacactgcaaagcttgagattcagattaagttggacaaagagaagaaaatcctctccattcgggataggggtattggtatgaccaaggaggatcttattaataaccttggaaccattgctaagtctggcacttcagcttttgtcgaaaagatgcagtctggaggtgacctcaatcttattggacagtttggtgttggcttctactcggtgtacttggttgctgactatgtcgaagtggtcagcaagcacaatgatgataaacaatatgtttgggaatcaaaagctgatggatcgtttgctatctccgaggatacatggaatgaaccccttggccgtggaaccgagataagattacatctgcgagatgaggccaaggagtacttggaagaggataagcttaaggatttggttaagaagtactctgagttcatcaacttccctatctatttgtggtcaaccaaggaggttgatgttgaagtgccagctgatgaggatgagacaagtgaagaagaggattcgtccccagaaactacagaagaagagacagaagaagatgaagagaaagagaaaaagcctaagacgaagacgataaaggagactacttctgaatgggaacttctgaatgatatgaaggctgtatggcttcgcagcccgaaggaggttactgatgaggaatactcgaagttttaccactcactagccaaggacttcggtgatgacaagcctatgggttggagccacttcactgctgaaggagatgttgagttcaaagctttgctcttcattccaccgaaggctccgcatgatctctatgagagttactacaacagcaacaagtcaaacctcaagttgtatgttagaagagtgttcatctctgatgaatttgatgaccttcttccgaagtatctcagctttttgaggggtattgttgactcagacacactgccgctgaatgtgtcacgagaaatgctccaacaacatagcagtctgaagactatcaagaagaagctgatccgcaaagctcttgacatgattaggaaacttgctgaagaagaccctgatgagtacagcaacaaggataagacagatgaagagaaaaatgagatggaggagaagaagggccagtacgccaagttctggaatgagtttggcaaatcaatcaagctgggtatcattgaagacgcaactaacaggaaccgccttgcgaagcttcttagatttgaaagtaccaagtcggatggcaaacttgcctcccttgacgagtacatttcaaggatgaagccagggcagaaagacatcttctacctcacgggaagcagcaaagatcagctggagaagtctccgttcctggagaggctaaccaagaagaactacgaggtcatcttcttcaccgaccctatggacgagtacctgatgcagtacctgatggactacgaggacaggaagttccagaacgtgtccaaggagggcctgaagctgggcaaggactcgaggctcaaggacctcaaggagtcgttcaaggagctgacggagtggtggaagaaggccctggagagcgagagcgtggactcggtgaaggtcagcagccggctgcacgacaccccctgcgtcgtcgtcacctccaagtacgggtggagcgccaacatggagaagatcatgcaggcgcagacgctgtcggactcgagcaagcaggcgtacatgcgcggcaagagggtgctggagatcaaccccaggcaccccatcatcaaggagctccgcgacaaggtcgcccaggacaacgagagcgaggagctgaagcagacggcgaggctggtgtaccagacggcccttatggagagcgggttcaacctccccgaccccaaggagttcgcgtccagcatctacaagtcggtgcacaagagcctggacctgagccccgacgcggccgtggaggaggaggacgaggccgaggagcagccggaggtggaagagaaggagccggcggccaaggaggggtcggagccgtccttcgacaaggacgagctgtagtcggcgtgctgtggtctcgtctcgtcttcgggatctgttttgaagtctagctgtagctcccgtttagttgagatatcggggagcccactcactgccagctttgtgtttaggaacgtgatacgggatctttttttttttgttgcctgtctttgtacttgtacaaacctcagttcagtgactcggtctaattaccggctccgatt

SEQ ID NO: 8556 - DNA, 2681 bp, Zea mays
ctcgtcactggtgtgggccgtggctgtacgccgcagagtgaagcgagacgagacgacgatgcgcaagtgggcgctctcctccgcgctcctccttctcttcctcctcaccaccctccccgacccagctaagaagctacaggtgaatgcggaagagagcagcgatgacttagctaacccacccaaggtagaggagaagcttggtgctgtccctcatggcctgtccaccgactctgaggttgcccagagggaagctgagtctatctctaggaagactcttaggagctccgccgagaagtttgagttccaggctgaggtgtccagactcatggacatcatcatcaactcactctacagcaacaaggatatcttcctgagggagctcatatccaatgcctctgatgcattggataagatcaggttcctttcccttactgataaggaagttctgggtgaaggtgacactgcaaagcttgagattcagattaagttggacaaagagaagaaaatcctctccattcgggataggggtattggtatgaccaaggaggatcttattaataaccttggaaccattgctaagtctggcacttcagcttttgtcgaaaagatgcagtctggaggtgacctcaatcttattggacagtttggtgttggcttctactcggtgtacttggttgctgactatgtcgaagtggtcagcaagcacaatgatgataaacaatatgtttgggaatcaaaagctgatggatcgtttgctatctccgaggatacatggaatgaaccccttggccgtggaaccgagataagattacatctgcgagatgaggccaaggagtacttggaagaggataagcttaaggatttggttaagaagtactctgagttcatcaacttccctatctatttgtggtcaaccaaggaggttgatgttgaagtgccagctgatgaggatgagacaagtgaagaagaggattcgtccccagaaactacagaagaagagacagaagaagatgaagagaaagagaaaaagcctaagacgaagacgataaaggagactacttctgaatgggaacttctgaatgatatgaaggctgtatggcttcgcagcccgaaggaggttactgatgaggaatactcgaagttttaccactcactagccaaggacttcggtgatgacaagcctatgggttggagccacttcactgctgaaggagatgttgagttcaaagctttgctcttcattccaccgaaggctccgcatgatctctatgagagttactacaacagcaacaagtcaaacctcaagttgtatgttagaagagtgttcatctctgatgaatttgatgaccttcttccgaagtatctcagctttttgaggggtattgttgactcagacacactgccgctgaatgtgtcacgagaaatgctccaacaacatagcagtctgaagactatcaagaagaagctgatccgcaaagctcttgacatgattaggaaacttgctgaagaagaccctgatgagtacagcaacaaggataagacagatgaagagaaaaatgagatggaggagaagaagggccagtacgccaagttctggaatgagtttggcaaatcaatcaagctgggtatcattgaagacgcaactaacaggaaccgccttgcgaagcttcttagatttgaaagtaccaagtcggatggcaaacttgcctcccttgacgagtacatttcaaggatgaagccagggcagaaagacatcttctacctcacgggaagcagcaaagatcagctggagaagtctccgttcctggagaggctaaccaagaagaactacgaggtcatcttcttcaccgaccctatggacgagtacctgatgcagtacctgatggactacgaggacaggaagttccagaacgtgtccaaggagggcctgaagctgggcaaggactcgaggctcaaggacctcaaggagtcgttcaaggagctgacggagtggtggaagaaggccctggagagcgagagcgtggactcggtgaaggtcagcagccggctgcacgacaccccctgcgtcgtcgtcacctccaagtacgggtggagcgccaacatggagaagatcatgcaggcgcagacgctgtcggactcgagcaagcaggcgtacatgcgcggcaagagggtgctggagatcaaccccaggcaccccatcatcaaggagctccgcgacaaggtcgcccaggacaacgagagcgaggagctgaagcagacggcgaggctggtgtaccagacggcccttatggagagcgggttcaacctccccgaccccaaggagttcgcgtccagcatctacaagtcggtgcacaagagcctggacctgagccccgacgcggccgtggaggaggaggacgaggccgaggagcagccggaggtggaagagaaggagccggcggccaaggaggggtcggagccgtccttcgacaaggacgagctgtagtcggcgtgctgtggtctcgtctcgtcttcgggatctgttttgaagtctagctgtagctcccgtttagttgagatatcggggagcccactcactgccagctttgtgtttaggaacgtgatacgggatctttttttttttgttgcctgtctttgtacttgtacaaacctcagttcagtgactcggtctaattaccggc

SEQ ID NO: 8557 - DNA, 2385 bp, Zea mays
tgcggagatgcagtagaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgccggtggggaggcggcgggtgtttgtgcagacggagaccggctgcgtgctcggcatggacctggaccgcggggacaacgcgcacaccgtcaagcgccggctgcagctcgcgctcaacatgcccaccggcgggacctcgctcaccttcggcgatcgcctcctggagaacgacctgtccttcatacgcccggactcgccgctgctgctcacccggaacagcatcaaccggagctgctccaccccgtgcctctgccccgtctccaaggacttcgagcacaaggactgcagcggactggttgagatgctcggctgttccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggaggttatgtgtatggaggccaggaagagagtagcagagtgggagcccttctctgccacggctgaacatggagaagataccgatttccagttctcggtggatatgctaggagaatacagtgatgtagtgcgatcaccgaggttcaatggctcaggttccaaggtgtccagtttcagaagccctttgtctaagctcgtcgagagtgtcgacgagggcagtgatggccatgaagatcaaaacgagtctgatcgagtcttgtatgctggatggaatacatccagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagaggcactgcacgagagcgcaagggcagcagtaggtcaaaggatgaagcagcggctgggcacttcatgcaagttttgagcagggcaatagcgcatcagagaagaaaaaaatgcagtgctacttgtactgcttgcttatggagtgagtacaggatgaagatatcatcgtatgtggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaatgtttgtcagcctgtgt

SEQ ID NO: 8558 - DNA, 1310 bp, Zea mays
ccaccgcaaccgtgtgaccgcccgtgccgccggcgatcccgatccgccgacccgtcccagccccgctcgcagccatgtcgccgtcggagccgacgcgggaggagagcgtgtacatggccaagctggcggagcaggcggagcggtacgaggagatggtcgagttcatggagcgcgtcgcgcgctacgccgggggcgccggcggcggggaggagctctcggtggaggagcgcaaccttctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagctcgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggctccaacccaccccatcaggctcgggcttgctctcaacttctcagtgttctactacgagatcctcaactcccctgaccgtgcttgcaaccttgcaaagcaggcctttgatgaggcaatctcggagctagacagcctgggagaggagtcctacaaggacagcactctgatcatgcagctcttgcgtgacaacttgaccctatggacttccgacaccaacgaggacggcggggatgagatcaaggaagcagctgctgcccccaaagaatccgcccccgagggccagtaagacgatccgatctccggacctgatgcgtgtctgctgatgtcggggagtttaccaggactgtgccgttcttgatttcttatagcttatcttctagtacacttcgtgttgttctcttcgtcacggcgctggcgtgccggtgcgcgtgcgccgaagctgcctgccattgccattgccattgccgctgtttttaattaagcacacactctagatgttatgcccgcatgctatgtttcgattctcaagttgataaatgatggctggatgctggttttcgtgctccaagcctgctgcttcttccagggaaaaaagacctgcccttgttgcagcgttgttgtttagaatgacctatatttgactggtattctgttacggtggctttgcaaagctgtttgtttggtttaatgtctcggaataatatgaattggctgc

SEQ ID NO: 8559 - DNA, 1357 bp, Zea mays
gccgcctctcaacaggccgcgcgggaagcgcaaggccctggccgagctccccaagtccaacggactgaacatgaaccacgactcggcgccgcggccgtcgaagccgagaacgcggtcggcggcgcgagctgaggccgaggcggaggcggcgatgaaacggcggaaggccggagacgccgcgcgctggccgatggacacgaggcagcctgacgctgaagcggcggttgcgccatacgtcggggacatcgaccggtacctccggtccctggaggttgaaccgttgaggaggccaagccatagctattttcaggatatccagaaaaacatctgccccaaaatgagggctatccttgtggactggttggtggaggtggctgaagaattcaagcttcacgcagaaacactccaccttgcggtttcctacgtggaccgctttctcacaatgaatgtcgttgctcggaacaagctgcaactactgggtgtcactgcattgctcgttgctgctaagtatgaagaaattgagtcttctaagatgaaggtggtcaagatggagactgacttactaaaatctcttagctttcagattgggggtcccacagtgacaacatttctacggcaatttatagcttcgtgtcgtggaggcaatagtgcaagcagaggaaaacttgagtttgtgtgcagctaccttgcggaattgagcttgctggattatgactgcataagctatctaccctcagtagttgctgctgcctgcttgtttgtagccagattcataatccacccaaagactcgtccttggaacttgtcacttgaacaaagcacgggttatagagtctttgatctgcagaaatccatttatgtcatacatgaattgcagttgacaataaggtgcccaaatcaggtagccatcagggagaagtacaaggaccccaagtttgggtgcgtgtcgacaatggtttcaccacgagaaatccctacgtctttccttgaaggttgccataagtgaagtccggacttggacttggagaagggtttttgcagtaatgctgctggcgagtggcgatgcagaaaatagcttgatggtaggataatttaagggtaggtcggaaaatataccatggccagcgttgtagatcgttggtacggtactggtctcacagttggtagaatatgcaattgaaggctttttgtacaggagttaggctagtccgtgacacacacgtgtgcatcctctatggtctgtctttgcgcacattatgccgagcgccgaccatctcgtgctgttggcctgtctcaattaccaccagacatttgacacgtggaatctttttaagattcaatttttaaaaattgtatt

SEQ ID NO: 8560 - DNA, 1454 bp, Zea mays
ccacccaccaccaccactcctcccctcgccgccgcccgttcccgaccgatccggccggatcgccccgccatggaccagtacgagaaggtggagaagatcggggagggcacgtacggggtggtgtacaagggcaaggaccgccacaccaacgagacgatcgcgctcaagaagatccgcctcgagcaggaggacgagggcgtcccctccaccgccatccgcgagatctccctcctcaaggagatgcagcaccgcaacatcgtcaggctgcaggacgtcgtgcacaacgacaagtgcatctacctcgtcttcgagtacctcgacctcgacctcaagaagcacatggactcctccacggacttcaagaaccaccgcatagtcaaatccttcctctaccagattctgcggggcatcgcctactgccactcgcaccgcgtgctccaccgcgacctgaagccgcagaacctgctgattgaccgccgcaacaacctcttgaagctcgcggactttggactggcgagggcgttcggcatccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagattttcagaattttgggcactccaactaaagaaacatggccaggcgttgcttcgttgcctgattacaagtcaactttcccaaagtggccacctgtggatcttgcaacggtggtcccgacactcgaaccgtcgggaatcgatctcctatctaagatgctgcgtctagatcccagcaagaggatcaccgcccgcgccgccctcgagcacgactacttcagggacctcgagcacgcctagcaggatatggatggatggatgaaccgtttcccctcccctgctccctctgtaaattacggtagcagccgcgatgcttggggccggcgagtacccccgtctgggcggccgttgagttatgtgtgttactctatagtatgactaagctggagtgcctcatgtccaccatgcagtgcagcttttttctccgacttttttttgctgcgtagagaaatgagatgagaaatgtgatccagagatccttgtgccatgggagacctagtagtagactagtagctatgtaggtgtcggcactggcctctcttgaacctgtatgatggctggagagagaggagagacggcggcttctctggttgataagttggtcctggtatggtgtgcttgccgccgatgcacgtcatggtctttcttcctttctgatgaggacttggggtggacgccgagtgagttcgtgctcatgcacggtttgttggccatgcaagctgaagcagctgcagcagagattttgg

SEQ ID NO: 8561 - DNA, 3017 bp, Zea mays
gctcggtcgactactggctagcttgtttcagtcgtccgatctgatctacagaaaaagcaggggcagggcagctagccatgattcagatgaacatgaagcagcctctcgtgctgcccgcgcaccggggcaatgtcatcggctcgcgcctggcgtcgtcgccctctccggtggcggcggcggcggcggcggccagcaggcggaggggcgtcgtgtcctccccccgctcccggctccagcgccacatgcggctgccgaggatcagctgcagcgccaccgaggaggccagcggcgccgtgtcggccgtcaccgtggagaagatgctgacggtgacggcctcggtgcaggcggcgccggccatcggtcagatgtacttccagcgcgccctcgacgacgccggcgacttcttcggcaagacgctgctgatggaactcgtcagctccgaggtcgacgcaaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgtccgacacgcccaagggcctggaggacctgaggaagaaggacctgcaggcgcttcggggcgacggccacggcgagcgcaaggcgtccgagcgcgtctacgactacgacgtgtacaacgacctgggcgacccggacaagaaccccgcccaccagcggcccgtgctgggcggcagcaagcggtacccgtacccgcgccgctgccgcaccggtcgccccaggaccaggaaggaccccgaggcggaggtgcgccatgggcacaactacgtgccccgcgacgagcagttctcggaggtcaagcagctcacgttcggggccacgacgctgcgctcgggcctgcacgcgctgctcccggccatcaggccgatgctcatcaagagggagctgcgcttcccgcacttcccggccatcgacgacctctacagcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagtccgccatcaccaaggagatcctggagaagcacatgagcggcggcgccgccatgaccgtggagcaggcgctcgcggcgaagcgtctgttcatcctggactaccacgacgtgttcctgccctacgtgcacagggtgcgcgagctgccggacacgacgctctacggctcccgcaccgtcttcttcctcacggacctgggcacgctgatgccgctggccatcgagctggtgcggcccaaatcgccgacgcagccgcagtggaagcgggtgttcacgcacgggcccgacgccaccgacgcctggctgtggaagcttgccaaggcgcacgtggtgacccacgacacggggtaccaccagctggtgagccactggctgcgcacgcactgctgcgtggagccctacatcattgccgcgaaccggcagctcagccggctgcacccggtgtaccgcctcctgcacccgcacttccgctacaccatggagatcaacgcgctggccagggaggcgctcatcaacgccgacggcatcatcgaggagtccttctggccgggcaggtacgccgtcgagctcagctcagcggcgtacggcgccacgtggcagttcgacacggaggcgctgcccaacgacctcgtcaagcgtgggctcgccgtgcgccgggacgacggcgagctggagctcaccatcaaggactacccctacgcgcacgacgggctcatggtctggaacaccataaggcagtgggcggccgactacgtcaacgtctactacaagtccgacgaggccgtcgccgccgaccccgagctgaaggcgttctgggacgaggtgcgcaacgtgggccacggcgacaagaaggacgagccgtggtggcccgtgctcgacacccgcgacagcctcgcggagacgctcaccaccatcatgtgggtcacctccggccaccactcggcggtcaacttcgggcagtaccacttcggcggatacttcccgaaccgcccgaccaccatccggaagagcatgcccgtggaggaggaggcgggccgggacgaagagatgaagaagttcctgaagcagccggagacgaccctgctggacatgctgccgacgcagatgcaggccatcagggtgatgacgacgctggacatcctctcgtcgcactcgcccgacgaggagtacatgggagagttggcggagccgtcgtggctggaggagcccatggtgaaggcggcgttcgagaagttcggcggcaggatgaaggagatcgagggattcatcgacgagtgcaacaacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttggaaataaaaataattaaaataaaaggtctcgtctgtactattgtattgtaccatggatcatatcgtacatgttgtgtcaatgcaaagaggcacgtttgagttaccattaggatgacattactagcagatcctttttatgtt

SEQ ID NO: 8562 - DNA, 2237 bp, Zea mays
ctttcccttcctcgtgccgacgaccgggcgaccgccgcgccccggcccgcgcccccttgtctcgggccactcgccggcaacgagcagccaccaggaaatgttgtgaggactgatgcaataactaagcttgctggatggacggatgtgattgcatcgagccactatggcctaccgatgatctccttgtcaagtatcagtacatctcagacttcttcatagccctagcgtacttctctattccgttggagctcatatatttcgtgaagaagtcgtccttcttcccgtacagatgggtcttgatccagtttggtgcgtttatagttctctgtggggcaacccatctgataaacctgtggacgttcaccacacatacaaagaccgttgcgatggtcatgaccatagcaaaggtttctacagcagttgtgtcctgtgcaactgctttgatgcttgttcatatcatccccgacttattgagcgtgaaaactagagagttgttcctgaagaataaagctgaagagcttgacagagagatgggactgataaggacgcaggaggagaccggtagacatgttaggatgcttacacatgaaatcagaagtactcttgacaggcatacgattttgaagactactcttgttgagctaggaaggaccttgggtctggaggaatgtgcattgtggatgccatctcgaagtggttcaagccttcagctttctcatactttgcaccaccagattactgttggatcatcggtgccaattaatcttcctgtcatcaatcaagtgttcagtagcaaccgggcaattataataccccacacatctcctttggcgcggattcgacctcttacagggcgatatgttccaccagaagtggctgcagtccgtgtacctcttctccacctttcaaacttccaaataaatgattggcctgagctttcagcaaaaagctttgcaatcatggttttgatgcttccatctgatagtgcaagaaaatggcatgtacatgaattggagctggttgaggtcgttgctgatcaggtagcagttgcactatctcatgcggctattcttgaagagtccatgcgagcacgtgatttactaatggagcagaatgttgccctggatttagctcgaagagaggctgagatggctatccgtgctcgcaatgatttcctagctgttatgaatcacgaaatgagaacacccatgaatgcaataatagccctttcctccttgcttttggaaactgaacttactcctgagcagcgtctaatggtggaaacagtactgaaaagcagcaatctgttagcaacactcatcaatgatgtgctagatctttccaaactcgaggatggaagccttgaactggagattaaagcattcaatcttcatgctgttttcaaagaagtgatgggtttcattaaaccaattgcatctatcaagaggctatctgtatcggttatgttggcaccagatttgccgttatgtgccattggtgatgaaaagagactcatgcaaactattctgaacatctctggcaacgctgtaaagtttaccaaggagggacacatcacacttgtagcttccattgtgaaggctgactctttgagagagttcagaaccccagaatttcatccaactgcaagtgatgaccatttctatttgaaagttcaggtaaaagatacaggctgtggaattggtccacaggatctacctcatgtatttacaaagtttgctcatcctcaaagcggaggaaaccgagggtttaatggtagtggtcttggccttgccatatgcaagaggtttgttagtctcatgggagggcacatctggattgacagcgaaggaaccggaagaggttgcaccgcaacattcgtcgtcaagctcggcgtgtgtgacaacacaaacacctaccagcagcagctgatccctctagtatggccaagcagtgcagactccgatttgcgtgctccgaaagcgcttccggacgggagaggatctacacccttgaaatcccggtaccaaaggagcgtatgagcctagtgtaaatgattgacggcatagtgccaagtaggggaccgattagtgccaccgtctaattttgtttgtaaccctgtcatagcaggcatatgatgtacaaatactgtaaagcaaatggagactgcggccgtgtatctgggtggcaacgctgacttgctgcattgagtggtatatacatatgctaccagcggattg

SEQ ID NO: 8563 - DNA, 1973 bp, Zea mays
gcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgacctcaagcccgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccccccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatttcaagggcactgacaagaaaaggaacagctctggtcaaacttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaatgagttcttcaaggagcaaaaatacccagaagcaataaaacactacacagaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccgtggaaacctaccaggctggcttgaagcatgacccgaacaaccaggaactgcttgatggtgttaagaggtgtgttgaacagatcaacaaggccaacagaggtgaaataagccaggacgaattgcaagaaagacagaacaaagctatgcaagacccagagatccagaacattcttaccgaccctatcatgcgacaggttctaatagatttccaggagaacccaagtgcggcccaggagcacctgaagaaccccggggttatgcagaagattcagaagcttgtaagtgctgggatagttcagatgagatgatcgagcgatgcgatgattggctttgttcgttcacgtgcaccctggtcatacatatgttttaacaagcagcagcggcataagaatgaacctgttcgggggctaatcttattccttttggattgtaagtgcattgacattggataattcatgtttgtggcactgagtttcgagtatacgctactttctaatctttgagatgtgcgcacgct

SEQ ID NO: 8564 - DNA, 1025 bp, Zea mays
cgacgacggcggtcgcagcgtcccctccctccctccgtaccgctgccgccggtctaccaaaaggtgaaatatttacgcaagcgaaatcagtgtcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaactatttcctcctctggatggttgaggggatgaatggtgagcgggccagatcacgcccagctactcacagcgagcaacatactccatggctctcaagcagcagcagagcaaatggaaatgcaggctgctcaaatcccacaagacgccaccttccactgccaccgccggttgacactacttcgcccaccaatgcaaatcatgccaaccatggggtccctgtccctctgctgaacgcagagagggtacaggcttcgctgcgcaagtccttgtcgttcctggttcacctgacctccaagtttcccctggtgttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatgctgttgttgagtccttgtataactgaaccttccctagatcttgttgcaagcgtggatgctattgc

SEQ ID NO: 8565 - DNA, 2882 bp, Zea mays
tggctagcttgtttcagtcgtccgatctgatctacagaaaaagcaggggcagggcagctagccatgattcagatgaacatgaagcagcctctcgtgctgcccgcgcaccggggcaatgtcatcggctcgcgcctggcgtcgtcgccctctccggtggcggcggcggcggcggcggccagcaggcggaggggcgtcgtgtcctccccccgctcccggctccagcgccacatgcggctgccgaggatcagctgcagcgccaccgaggaggccagcggcgccgtgtcggccgtcaccgtggagaagatgctgacggtgacggcctcggtgcaggcggcgccggccatcggtcagatgtacttccagcgcgccctcgacgacgccggcgacttcttcggcaagacgctgctgatggaactcgtcagctccgaggtcgacgcaaagacgggtctggagaagccgcgggtgacggcgttcgctcacaagacgctgcgggagggccactacgaggcggagttcaaggtgccggcgtcgttcgggcccgtgggcgcggtgctgctggagaacgagcaccacaaggagatcttcatcagggagatcaagctcgtcacgggcagcgacagcagcaccgccgtcaccttcggctgcaactcctgggtgcactccaagttcgacaacccggagaagcgcatcttcttcaccctcaagtcctacctgccgtccgacacgcccaagggcctggaggacctgaggaagaaggacctgcaggcgcttcggggcgacggccacggcgagcgcaaggcgtccgagcgcgtctacgactacgacgtgtacaacgacctgggcgacccggacaagaaccccgcccaccagcggcccgtgctgggcggcagcaagcggtacccgtacccgcgccgctgccgcaccggtcgccccaggaccaggaaggaccccgaggcggaggtgcgccatgggcacaactacgtgccccgcgacgagcagttctcggaggtcaagcagctcacgttcggggccacgacgctgcgctcgggcctgcacgcgctgctcccggccatcaggccgatgctcatcaagagggagctgcgcttcccgcacttcccggccatcgacgacctctacagcgacggcatcccgctgccggcgcagaccgggttgggcgccatccgcagcatcgtcccgcgcgtggtcaagctggtggaggacaccaccgagcacgtcctccgcttcgagctgccggacatgatagagagagaccgcttctcgtggttcaaagacgaggagttcgcgaggcagacgatcgcggggctcaacccgctgtgcatccagctcctgacggagttccccatcaggagcaagctggacccggaggtgtacggcccggcggagtccgccatcaccaaggagatcctggagaagcacatgagcggcggcgccgccatgaccgtggagcaggcgctcgcggcgaagcgtctgttcatcctggactaccacgacgtgttcctgccctacgtgcacagggtgcgcgagctgccggacacgacgctctacggctcccgcaccgtcttcttcctcacggacctgggcacgctgatgccgctggccatcgagctggtgcggcccaaatcgccgacgcagccgcagtggaagcgggtgttcacgcacgggcccgacgccaccgacgcctggctgtggaagcttgccaaggcgcacgtggtgacccacgacacggggtaccaccagctggtgagccactggctgcgcacgcactgctgcgtggagccctacatcattgccgcgaaccggcagctcagccggctgcacccggtgtaccgcctcctgcacccgcacttccgctacaccatggagatcaacgcgctggccagggaggcgctcatcaacgccgacggcatcatcgaggagtccttctggccgggcaggtacgccgtcgagctcagctcagcggcgtacggcgccacgtggcagttcgacacggaggcgctgcccaacgacctcgtcaagcgtgggctcgccgtgcgccgggacgacggcgagctggagctcaccatcaaggactacccctacgcgcacgacgggctcatggtctggaacaccataaggcagtgggcggccgactacgtcaacgtctactacaagtccgacgaggccgtcgccgccgaccccgagctgaaggcgttctgggacgaggtgcgcaacgtgggccacggcgacaagaaggacgagccgtggtggcccgtgctcgacacccgcgacagcctcgcggagacgctcaccaccatcatgtgggtcacctccggccaccactcggcggtcaacttcgggcagtaccacttcggcggatacttcccgaaccgcccgaccaccatccggaagagcatgcccgtggaggaggaggcgggccgggacgaagagatgaagaagttcctgaagcagccggagacgaccctgctggacatgctgccgacgcagatgcaggccatcagggtgatgacgacgctggacatcctctcgtcgcactcgcccgacgaggagtacatgggagagttggcggagccgtcgtggctggaggagcccatggtgaaggcggcgttcgagaagttcggcggcaggatgaaggagatcgagggattcatcgacgagtgcaacaacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttggaaataaaaataattaaaat

SEQ ID NO: 8566 - DNA, 983 bp, Zea mays
tccctgcactgcaagcaacaaagttctactctgtccatctccgtccatctagctcccaagaaacaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctgctgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgcggcaaccggatcgagttcccggctttctaagctaactcactcttcacgtcagttgctgcaatatactctgctagtccttttgcttgcattctatgcaagaggataatggaatgttaattccccattcttcaaagtttttttttttgcaaataaaaggaggcgatcggtgttccatatttattatgttgatcataacataacattcagagaacaattcataagttcagtccc

SEQ ID NO: 8567 - DNA, 2340 bp, Zea mays
gagagatcagagtatcagacaagctgttgtccgaatccactccggcgaggacgagtgctgaggtcgaaatggggagaggagcggatgaggtggtgaaggtcgtggattcggaggacggcgagggggaggaggaagaggcagaggccgcggcggcggaggggtcgagcaaggagacgccgatgctgccaaggatgccggtgcgcgtgctactcgccgagggcgacgactccacgcgccacgtcatctccgcgctgctacgcaagtgcggctaccgagttgctgcagcctctgatggtgtgaaggcgtgggacatattaaaggaaaaatctttcaacatagaccttgttttaactgaagttgaactgcctttgatgtctgggttcctcttgttatccacgatcatggagcatgatgcatccaagaacatccctgttataatgatgtcttcacacgactctgtaagcatggttttcaaatgcatgctaaagggtgcatcagatttccttgttaagccgctaagaaagaacgaattaaggaacttgtggcagcacgtttggagaaaacaactggcaaacggtgggcccgatgtgcagcacatacaagaagagaatcttgcagaaagaatggaacagaagactggcgtgacaaaagatgataatttgaacagcgatggtccctgtaaaaatagagaatgcagtgaacaagaaagtgatgctcaaagttcttgcacaaggtcagagttggaggctgaaagtaagcaaactaacaacattttggagtatatgcaatcaactgaaaggcatttgtctattcgtagccacaaggatttagagctaaatggagagaccaaaacacgaactaagggtaataacttgattccaacaagagaagacgatttattgccaaagaaaagaacatgtttgaatgacaataattctgagagaacttccagagatatggagctagtccacattatggacaatcagcagaagcatgacacacagagggatgtggatactatgagaacaacatccaggagaaatgatgagaagaactccatcccagcacaccagttggaactttctcttagaagaactgactatggaaaattagagaaccacgagaaaaatgatagaagaacactgaaccattcaacttcatctgcattttacttgtataattgcaggacagcgtccagcttaggaaatgctggtgatggtcaattatgcagcacctcagaaacactagtggatgttgaaaatagaaatggagatttggcagctctgtctgaagacacgactgaaacaaatcgtcctcctatcagagttgtaccatttcctgtccctgttcaatgcttcacatttgatgggcagccgttctggaatggtacaccggtggcatctccattctacccacagtcagctccccccatttggaatagcaaaacaccaacgtggcaagaatcaactccacaagcaacttcactgccacaaaaatcgcaacagaaagaaccagttgaaatggatgctaaaccagttgaaaatgcagaggaacaatttgtcgtaggtcctcccagtgccagtgggaagcagctgcatgttgaaattcctaaagatgatctacggcatatttctcctgtgaccggtgaaagtggaatcagtacggtgctagacagcaccagaaatactctgagcagcagtggctgtgatagcacttccaaccagatcaccgcccctactgaaccatcatccaatgtatacaggggcgttcctgaaaccgcaagagccgaaggtttacgacacctgagccagcgtgaggctgcactgaacaagttccggctaaagaggaaggacagatgctttgagaagaaggttcggtaccagagccggaaattactcgcagagcagcgtccacgggtcaagggccagtttgtccgtcaagatcatagcatccaaggaagctagggtccagttactgagctggaactctttcccattatctacaaaaaaaagtcactgtaagtgactccactgcggggtaccctgatgtcaggttttttcgaagagttggaagcaaccacactgagttacggtttgctgtgtatgtttgctaaagcttgtaatatatgtatgtataggctgactcttttctttccttaggttaggcacaggacctggcacgttctagacggtttgtcggtagacgttaaaaaatacaggcatacttgtgtcctccagtagcacgtgtgctttaagccttgtattatgtaactagccaagttgtttttgatgtttcggattagatgtacactgtggatgtatggcgtgaaggatgtccacc

SEQ ID NO: 8568 - DNA, 2959 bp, Zea mays
ggtgagcgagacagattccacagcaatttgctcctcttccacgcacaggcaagactgctccccagaaaagattgtagttttcatcgatttagccggtttctgcccggggggatcgctgctggagatctcagagaaccgggaggctccgagcttttgctccgtttgcgtcgaatctgcctcgggagcggagaaaggagcggccttccgagctcgtaggggccgtccctgagaaggcgagaggggacgcggcggcggcggagtcagctctagggcgctcgtggaagtcggtgatgccggtggtttgaggacgaggcggcctcggtggttttgaggaagccagcctctgccgcggcaaggatggactccagcggggaggaactcctgaagaagatccgggaactggaggttgggcaggcgcagctcaagcaggagatgtctaagctaatacccggcgctggggagcgtcggcgctcgcaatccgtctcgccgcggcgcggcgtgccggtgccgccgccaccgccggccaaggcgaaggcgggggcgccaggtaggcggctgtccggggggtttgagggcgggcagcgcgcgtgggcccgtgggtcggcgtctttcccgcactcatcaccgctgcagcgggagggccgcgcaggcgctggagacgctagcaccagcgctaggctgccggagaggcagtactccagggtgcttcagtcaatggggcagtccgtccacattcttgacctcgacgggaggatcatatactggaatcagtctgcggagaatctgtttggctatcctgcatcagaagcccttggtcaggatgccctcatgcttctggttgattcccatgaccacaatgcggtaaataacatcttccaacgtatttctatgggtgaaagttggactgggaagtttccagttaagaacaagcaaggacatagattttcagctgttgccaccaatacacctttctatgatgaagatggcagtttgatgggtttcatttgtgtttcaagtgattcccgccaattggagcagatattttgtaagcctccgacctctgcaaggtcccagtcagaatcatctatgacatcttgtgatgggagttgcagcaacactagtcacagaatcaattcgttgaatagaagttcttttgattctaatctacccctgcaaagcactttagcatccaagataacgaatttggctaccaaggtcacaaataaagttcgttctcgggtcaggacagacgagaatgacgatggtggcagtggtgagagccattgcttggatcgtggtgcaaaggaagagccaacatctagcggaacaagcacaccaagaggggatgcaccacatggtccctttgctacagaagagaactcacctgggaaatcaacgaacccaaacagcgacgaatcagaaggaaaagtaggtctgcacaagattttgggttctaaggcagaggcactattgaacaagaaagggatatcatggccttggaaagggcgcgagaatgagggacctgatgaaagaaaccatgtgatattgccgtggttgcatggtggccaagagaatggtgtgaatcatcagaaggtttctgattctagtatatctccagacgcccaaggcgctgaacacaaccaacctagcaaaaatgaggcatcaggttcctggtcctctttcaacaataacagcacaggcagtgcaagcagcacgggaagcactaatagcagtgctctctacaaagtagatcatgaagcagattgtctggattatgagatcctgtgggaagaccttgtcattggagaacaaataggtcaaggctcttgtgggacagtatatcatgctttgtggtatggttcggatgtggctgttaaagttttctccaagcaagaatattcagaagaagtgatactgacctttcgacaagaggtatcccttatgaagaaattgcgccatcctaacatactgctcttcatgggtgcggttatgtctccacaacgcctttgtattgtatcagagtttctcccccgtggaagcttgtttcgcttacttcaaaggagcgctaccaagttggatgtgagacggcgtgtccacatggctttagatattgtaaggggcatgaattatcttcaccattccagcccgcctatcattcatcgagatttaaaatcatctaaccttttggtcgacaagaactggattgtgaaggtggcagactttggtctttcacgtctcaagcgtgaaactttcttgacaacaaaaacaggaaaaggaacaccccaatggatggcgcccgaggtgttgcgcaatgaaccttccgatgagaagtctgatgtgtacagttacggggttatcctgtgggaacttgttactcagaagataccctgggaaaatctgaactcaatgcaggtcattggtgcagtgggttttatgaaccaaaggttggatatcccaagtgaagtagatcctcagtggaaatcaattatcctgagctgctgggaaagcgacccgcagcaacggccgtcgttccaggagcttcttgagaggctccgggagctgcagaggcactacgccatccagcaccggaacacaaagaacagcatcgaggagtaaagaacacaatgcgacctctcagagcggcttgcttcgaagcattttgcgagcgaacgaacgaagaaccccaggtctctagaagggcctggaccctcctgtactgtatggttttgcttctgcggaacagccaaggctggaagaagtttgttgtacagacgggggtacgttcttctttgtttgacagggcaattgtgactgtaatctctgggtcctgacacccaagggtagggtagagactatagagtgagtagtgactgagctccggattgctggcgcatttgggttcttctgattcgtggcaatgcaaatgcgtggttaacaataacaaaaaaaaaaaaaaaaa

SEQ ID NO: 8569 - DNA, 2050 bp, Zea mays
ggcggcggttccaggcgaccatccaataatcgccaccctgacgcgagaaatctccggcaacttttggggaactacacgtgtatggagttttattagtattccaggggcatcacaatggcatactttcctgatgaagtagtagggtatatccttggttatgtaacgtcgcatcaggaccgcaacgcggtgtccttggtctgccaggcatggtacgacattgagcgtcatggccgccattcggtgcttgtaagaaactgttatgcggtgtgcccagagcgtgtacatatgcggtttcccaacatgcgtgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcatgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcgatgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccattttaagccttgttcagatattcctatacctcatggattggaagtgattagaaaaaaatatgaat

SEQ ID NO: 8570 - DNA, 1175 bp, Zea mays
ccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggaggagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggcggccgc

SEQ ID NO: 8571 - DNA, 978 bp, Zea mays
ctccaagaagctcttccaggccgccaggtccctcgtcctctccgcttctcaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggcgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggcgatcttgccattgttgttggaagaaacattattcatggaagtgatggcccagagacagcgaaggatgagatcgctttatggtttgaacccaaggagctggtctcttacaccagcaatgcggagaagtggatctatggggtgaattaacgagagagtcaatctgttttttttcccttcttttgatctcggttttcacataattgccgacagacctaggcacaaggatgtaataaagtcgctaccgtcacttcgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggcgatgcagatgtttctt

SEQ ID NO: 8572 - DNA, 1766 bp, Zea mays
ctcaccaccaccacacacgggagatagctatagctagcatagcaagccagccagtcagcgacttagcagcagctagctagccatgctgccgtccttcgtgtcgccgacggcgagcgccgcggcctcggtgacgcctccgccgcggccgataccaggcagctacgggccgccggtgctgggcccgctgcgggaccggctcgactacttctggttccagagccaggacgagttcttccggaagcgcgcggcggcgcaccgcagcaccgtgttccgcaccaacatcccgcccaccttccccttcttcgtgggcgtcgacccgcgcgtggtcgccatcgtggacgccgccgccttcaccgcgctcttcgacccggacctcgtggacaagcgcgacatcctcatcgggccctacaacccgggcgccggcttcaccggcgggacgcgcgtcggcgtgtacctcgacacgcaggaggaggagcacgcgcgcgtcaagaccttcgccatggacctcctccaccgctccgcccgcacctggtccgccgacttccgcgcgagcgtcggcgccatgctggacgccgtggacgcggagttcggcaaggacgacggcagcgacaagaagccctccgccagctacctcgtccccctgcagcagtgcatcttccggttcctctgcaaggcgttcgtgggcgccgacccgtccgccgactggctggtggacaacttcggcttcaccatcctggacatctggctggcgctgcagatcctgcccacgcagaagatcggcctcgtccagccgctggaggagctgctcatccactcgttcccgctgccctccttcctcatctggccgggctactacgtgctctaccgcttcatcgagaagcacggcgccgaggccgtggcctacgccgaggcgcagcacggcatcggcaagaaggacgccatcaacaacatgctgttcgtgctcggcttcaacgccttcggcggcttctccgtgttcctgcccttcctcgtggccaaggtcggcggcgccccggcgctgcgcgagcggctgcgggacgaggtgcggcgcgccatggtgggcaaaggcaaagacggcgagttcgggttcgccaccgtccgcgagggcatgccgctggtgcggtcgacggtgtacgagatgctgcggatgcagccgcccgtgccgctgcagttcgggcgcgcgcgcagggacttcgtgctgcgctcccacggcggcgccgcgtaccaggtgtccgcgggcgaggtgctgtgcgggtaccagccgctggcgatgcgggaccccgaggtgttcgagcggcccgaggagttcgtgccggaacgcttcctcggcgacgacggcgccaggctgctgcagcacctcttctggtccaacgggccggagacggcgcagcccgggcccgggaacaagcagtgcgccgccaaggaggtggtggtggacacggcgtgcatgctgctggccgagctgttccggcgctacgacgacttcgaggtggagggcacctccttcaccaagctcgtcaagcgccaggcgtcgccgagcgtggcgcaggcagcagccgccgccggagcgcagcagtgagtgcgctgtataggatccatcggtggcgtgcgacgtcgccggcgccggccaagcaataaagtaaattgagtaggccctcctcgtcatccacatgctcgtctgtgttcgacttcgatcggtgtctcttcctcccggccggccgctggccgccggcggccgttgtggtaat

SEQ ID NO: 8573 - DNA, 1531 bp, Zea mays
ggacgaggacacacgcacacacggaagaagccactagctctccgcagtccgctctcgcctctcggccttctccttgtgccgccgaacaccctcacaagagtcggcctctcgatttctcagtccagcctcagcagtccccttccctccctccatcaggtgttgcctcccgcagatccaaatcggaattcggtccttcgtccccaaaccaccaatccggttgcattctttgggtttgctcacagcgcacacaaagccattttactgctgggaatggtggctggcactattagcgtctccggctcttgagtgatctccaagggaagtgaagtgatgggggagtgcgaggacggcaaggagtacaggtgctgggaggagctgctgccggacgcgctgggcctcatcttccgcaacctgccgctgcaggaggtgctcaccgtcctgccgcgggtgtgcaagtcctgggggcgggtggtggccggcccctactgctggcaggagatcgacatcgaggagtggagccagcagcagggcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatgggggcccgcggcctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccggcagcgacgacgacgacgacgaggccgtctgggacgacgacggccagggcctggagaacctggaggtcaggttctacggcggtggcttcggcgagaccttcgccggcttcgactggccgccgtcgccgtgacatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcgaactgctagtggtgcaatctaaaatgtagacgctggtgtttacatg

SEQ ID NO: 8574 - DNA, 894 bp, Zea mays
gtgccgttgaggcataccgcatacgtttctcccccattcctctccccactccgaaccctagccaccgtgctcacttcccaggtcgaacccgccgcggcgcgagtccacggcagtgcaggacctgatcctgcggtctaggccgcggcggtgagatggtgatggtgtcaggcggcggggggaacgcgtgggcgaaggagatgaccctccgccgcaggatagccagcatattcaacaagacgcaggaacacttccctactctgaaagactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaagcaaatgatacggctgctgggagttctcagggtattagtggcggggcaggagttcagggccagtatgcacctgccgctgttcttgggggagtggctcagcctcgccccacaggtatggcgccccaactaatcggcagtgggtcggatcctctgcaaggagacgacgaggagaccaggagactacgcgcagagcgagcagcacgggctggcggatggactgctgaattgagcaagagaagagcgctggaggaggcgtttagcgccatattcatctaggattagatcaaaaagcaacacatggcctggaggaaagccagcatacttaaaatggctgtcaaactacaaagcgttggatgatctgtgtcgtgattatctttgggacatggaattctcacaaattgtggtgaagcaccctttgtgtgcctttggttgc

SEQ ID NO: 8575 - DNA, 2130 bp, Zea mays
gcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaggccactctgactgtcactctgagcttcgcgtcacctgagtactgacggacgacatggggaagttgaggacatgtacacccaagacgggaccgtggacatgaaagggaatcccgccgtgaagaagggcaccggcaactggcgcgcctgcccctacatcctcgcgaacgagtgctgcgagaggctggcttactatggcatgagcaccaacctggtgaactacatgaagacccgacttggccaggtgaactccgttgcctccaacaacgtcaccaactggcaagggacgtgctacatcacgccgctcatcggcgccttcttcgccgacgcgtacatggggaggttctggaccatcgccatcttcatgatcatctacattttcggcctggcgctgctgacgatggcttcgtcggtgaaggggctggtgcctacgtcgtgcggcgacaaggatgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacagtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccgtcatcgaggggagccgcaagctggagcactcggagcagctggcgtgcctcgacagggctgccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggtaacacgctggaccagagcatggggccccggttcaagatcccctcggcgacgctgtccatggtggacaccatcagcgtcatcgtctgggtccccgtgtacgaccgcgccatcgtgcccctggtgcgctcctacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgaggacgacatcgtgcccatctccatcttctggcagataccgcagtacttcatcatcgggtgcgcggaggtgttcaccttcgtggggcagctggagtttttctacgaccaggcgcccgacgccatgaggagcatgtgctccgcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgccgtgctcagccttctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgcctgtctgtcgacttgttttgccacagtttgggtgcttaaacgttaacgtacgtactagttcaatatagtgtctcgggggcgaattggttgtttacatgtcatgtgtttatatatgcgcaatgttcgatcttagtggaat

SEQ ID NO: 8576 - DNA, 1569 bp, Zea mays
ccacgcgtccgcccggccaagggatggacgcgcttcgcctacggccgtccctcctctccgtgcggcccggcgcggcccgcccgcgagatcattttctaccaccatgttgttccatacaacgaaatggtgaaggacgaatttgcttttctagccaaaggacccaaggtcctaccttgcatcaccatcagaaattcttcgaatggaaatcctcctattgtaggatatcacatcgatcattaaatacttctgttaatgcttcggggcaacagctgcagtctgaacctgaaacacatgattctacaaccatctggagggcaatatcatcttctctagatgcattttacagattttcccggccacatactgtcataggaacagcattaagcatagtctcagtttcccttctagctgtccagagcttgtctgatatatcacctttgttcctcactggtttgctggaggcagtggtagctgcccttttcatgaatatctatattgttggactgaaccagttattcgacattgagatagacaaggttaacaagccaactcttccattggcatctggggaatacacccctgcaactggggttgcaatagtttcggtctttgccgctatgagctttggccttggatgggctgttggatcacaacctctgttttgggctcttttcataagctttgttcttgggactgcatattcaatcaatctgccgtaccttcgatggaagagatttgctgttgttgcagcactgtgcatattagcagtccgtgcagtgattgttcagctggccttttttctccacattcagacttttgttttcaggagaccggcagtgttttctaggccattattatttgcaactggatttatgacgttcttctctgttgtaatagcactattcaaggatatacctgacatcgaaggagaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacctgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggtaccccacgctgcttgatgatatcccatgtgtccgggtgatcgtctctagagagattggttgcacaacgtccaacatagcccgtaggtattgctaccactgctagtatgatactccttcctagtccttgccaaaaaaaaaaaaaaaaaaaaaaaaaag

SEQ ID NO: 8577 - DNA, 1825 bp, Zea mays
cgccgccgccaccaacgcaacgcgcgccgccgcagatctccgccaccgacgcgccggccatggagtacgagcgcattgagaagccgttccccgtccagggcggcgggttctcgcccaagcggctgcgcgcgatgctgctgggggtggacaagcgccgcaaggggcaggacggcgccgccgaggaggacgaggacggcggcggcgactacggcgccctgccgaaggcccacgccagatccggcgccggcgacggtggtggcggtggaggcgccacgtgcgaagaatacaaggacgtggacgtggtgagcaccacctcagagttctcgtcctcgctggagacagcgggtgggcaccggccccgggacgctcaccccgtcgccacgggttctaggaccagggtgccgcccgaggaggactcgtgcgactcggagagcgtggcatccaacttcgagttccacaaggagcggcgggcagcggcgtcggcggcggcgtcggtcgtccctccattctcaaagcccgccccgtcaaagtgggacgatgcacagaagtggatcgccagcccgacggcgaactgccctggcaggggtggcgcggctcctgcgccgaagaagacagagaaacctggctccggcatcgggaggctgccgctgccggcgaccaaggtcgtggtagaggccacttaggagatagataccaagaggatggatccgagccaggagaagcgagagattgggtggcagaaagcggcgaggtgggccccgcccgacccctgtccggaggcggagccctgcccaacaaagaccacactactcgctgtagaaactacagtggctgctgcttcagcagctgttaatttcaaccgccatgatgcatccaccacgcttcagagcgcagcaacatgcatacctcctccaacaacggtccggtcagtgtcgatgagggacatgggcacagagatgacgcccatcgcaagccaagagccgtcccggaccgggacgccggtgagggcgacgagcccaaactgctcccagccaacgactccacggaggacgctcggtggccccagcgcagtcggctccttcatcagccacggaggagaatgcagcagctcggagctgagcgagcaggagctgcagaccaaaaccaggagggagatcatgctccttggcacgcagctaggcaagaccagcatcgcggcatgggcgagcaagaaggaggaggagaaggacgcctcgctctcgctgaaaccggtgcccatggaccagtcgacgcagaacataaccgcgatccgtgcggctgcgtgggaggaggcggagaaggccaagtatttagcgagattcaagcgagaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccacggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgttgtaactatatatatatatatatacacacgtatgtaaggtgtgagatccatgcgtcctgtgctgtggtggttactgtgtaagtgtcacagatgtaccgaattcaaggccgagcttggattcctagtgcacatatgtgataaacttcacacc

SEQ ID NO: 8578 - DNA, 1491 bp, Zea mays
caaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagctgctgggcccggagctgcaggagatgcgcggcggcctgatccgcctctgcgccgacgcggaggcgctgctggaggcgcactactccgacctgctggcctccttcgacaacccgctggagcacctgtcgctcttcccctacatcaacaactacatcctgctgagccagctggagcacggcctgctggcgcggcacgtgccgggcccagcgccggcgcgcgtggccttcgtcggctccggcccgctcccgctgagctccctggtgctcgcggcgcgccaccttccgggcgcctccttcgacaactacgacatctgcggggaggccaacgaccgggcgcggcggctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccggggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacggcgccgtgctcaaccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatatatctcatctaatatccatccatccatctatagcagtattatgtatgcatccacatggtaataatctggctgaccgcatccgcatatggtcgtctcatcgtccatctataccttgaaagctactaattaattactgagttattattaatactgtttttactactactacgtactattaatattactacaactacctcatctagctggtgtattaattgattttgtctgttactactgtactactgttgtttcaacggtcatatcatcatcatcattgttgttgctgctgcct

SEQ ID NO: 8579 - DNA, 1549 bp, Zea mays
tctccatctcccctcgtcttcctccctccttcagcccgaggaaaccctagcacgtcccgtctcgcctcgccgccggcgatggccgctgcatgatcggtttccccccttggaactgcctgcctaccggcatcgccaagatcgccgccgcggctgccgtcgtcgtagcggcgctcgcgtcctccgggatcgccctcccgcgtccacgcgccgcgccgcccccatcgggattcggcctcctcatgtcgaaggcgaaggtctacaccgacgtcaacgtcctgcgtcccaaggagtactgggactacgaggcgctcaccgtccaatggggtgagcaggatgactatgaagttgtcaggaaagttggaagaggtaaatatagtgaggtctttgaaggcatcaatgttaacaacaatgagaaatgcatcattaagatccttaagcctgtcaagaaaaagaagatcaaaagggagatcaaaatacttcagaatctctgtggaggtccaaacattgtgaaattgcttgatattgtcagggatcagcattcaaagactcccagtttgatatttgaattcgtcaacaacacagacttcaaagttttgtaccccacattgacggattatgacatccgctactacatatatgagctactcaaggcccttgattactgtcattctcaaggcatcatgcatcgagatgtcaagccccataatgtaatgatagatcatgagcttcgaaaacttcggttgatagactggggcttagctgagttctaccatccaggcaaggaatacaatgtccgtgttgcatcgaggtatttcaagggacctgaactccttgttgatttacaagactatgattattctttagacatgtggagtcttggttgcatgtttgctggaatgatatttcgcaaggaaccattcttttatggccatgacaaccatgaccaacttgtgaagattgcaaaggtccttggaacagatgggctgaattcttatttgaacaagtaccacattgagctggaccctcaacttgaagctcttgttggaaggcatagtagaaaaccctggttgaagttcatgaatggtgataaccaacatctagtatcacctgaggccatagattttctcgataagctcctgcgctatgatcaccaagacaggcttactgcacgggaagctatggcacatccctacttccttcaagtcagagctgtggagaacagtaggacgagagcacaataatcatggtctgcactcttgaaatggagttgttgctagttcgtgaaaatcataggcttaaatccatgttcagtattcacatcgctccaggaatctgggccatgactccatggcaatgaatcaaaatagtacgagccgcatcatgtggacaaccttggcagatctttttattcttgtctttattgctgggagcactgtagctttaaacctacaagtagtgcttgaatgagatgagattcatatcatctcctgtggtggaatgtgaaattgtatgtgacctttagactaattaaaaagtacaatacagcgct

SEQ ID NO: 8580 - DNA, 754 bp, Zea mays
gcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 8581 - DNA, 1352 bp, Zea mays
cgagcaacagagcagaagcaaagcgcagagctagcaagtgaccgaccgagagcaaataggcaaggcaacgcaggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcaacgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactcggacccggtggcgctcggccactacatggtgcagcagctcaacaggcatagcggcttgctctactgccacatggtggagccccgcattaccgcccacgggcgcaggcagatccctcacgggctcttgccgttccgaaaggcgtttcatggaacgttcatcgccgccggtgggtacgatcgggaggaaggcaacaaggtggtggcagaagggtatgctgacctcgtcgcgtatgggaagctgttcttggctaacccggacctgcctaggaggttcgagctggatgtggcactcaacaaatacgaccgctccaccttctacacgcaagatcctattgttggctacacagattaccctttctttgaagaagaagatggcaagaatgagaggtgaaatctgataatgtggagggttcatcaagtataagttcgtcattatttccaccattcattattggtcattgtggtggagtcattgtgtcatgttgtttcattctgtactagtgtggtgtgaagtgaaataaatctatttggtgaaattgttat

SEQ ID NO: 8582 - DNA, 1210 bp, Zea mays
gcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccaggg

SEQ ID NO: 8583 - DNA, 922 bp, Zea mays
ctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtcaagccatggctcgacttcaaggagctccaggaattcagccacaagggggacgccaccgccttcaccaacgccgacctcggcgccaagcaaggtggacatgagcctggttggcgtgaggttccagtagaggatcctgtggtcaaagatgctgcacaccatgctgtgaaatcgatccaagagaggtccaactccctgtttccctacgaacttctcgagatccttcgtgcccatgcacaggttgtggaagactttgcaaaatttgacattctgatgaaactgaagagaggcagcaaggaggagaagatcaaagccgaggtccataagagcctggaaggggcctttgtgctaaaccagcatcagccggcggagcatgatgagtcgagcagccagtgaactgacgtaactgtgtgagctgtagtagtaacgtacttcgtgttacgtagaagaataaggagaaaacgaccaatccggttttatctggatgtcatgtatggtcgacggtcgttgctggcttggcttccgaacgcagcaggcatactggtgctggaagacggtacctgctgtcgcacttgccgttataataggcattggaacttgtcgatttcgggagctgatctgtttgtaccgtattgtttatttataatatgatggatcgtatgttgat

SEQ ID NO: 8584 - DNA, 1289 bp, Zea mays
ctcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctatccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgagaccgagctcgcccgcatctgcgatggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgctgccccgaaagaatccgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgtt

SEQ ID NO: 8585 - DNA, 1597 bp, Zea mays
cccaatcgccggccgacactcacaagaacctgcctccctctggatcgctatctcttttctagtgcccagggaaagctagctagctcacagctgagctgagggaagaaagcaaggagagggagccagggaggaaggggaaaaacacgcggagagggtgagcaagaaagaaccgaggcggatcgccttctgttcctcctgccggctccgcgagaggaggcactgctcagtcccgtgattcctacagggggggaagaaagaggtggaacaacgcccggggcagagcagagatgatgcgggagacgtacatggacgtgctgccgccggtggaccacatagccgcacggagcaactggttcccggcggcggcgcgtctgtggacggcggcggagaacaagcagttcgagcgggcgctcgccgggctcgacctctgccgcccggactgggaggaggtggcgcgggccatccccggccggacggtgcgcgaggtcgtcagccacttcaagcacctcgaggtcgacgtccagcagatcgagagcgggcaggtgcccttgccggcctacggcggcggggccagctcgttcaccctgcagtgggacggctacggccccggtccgggggacttcaggcacgggtaccgcttcgccggaggctgcgggaggcggcaccacggccgcacgccggagcaggagcggaagaagggcgtgccatggacggaggaggagcacaggttgttcctcctaggcctgaagaaatacggcaagggtgactggaggaacatttcgcgcaacttcgtccagaccaggacgcccacccaggtggccagccacgcgcagaagtacttcatcaggctcaactccggcggcaaggacaagaggaggtccagcatccacgacatcaccacggtcaacctgacggacgaccagccgccctcgccgtcccagtcctccctaatcaccagccaatcgaacgcaccagctacagctccggccgcggggatatgccaggtcccattggcggccgacgccaagcgacacggtgccggaactctgcccttcagctcaccgaaccggacctctgcggcgccggcctacaggatggagtttcatgaccaacaaggcctgcagtgtggccctctgcatgatcagttgctcgccagccagagcgtcctgttctaggcgcggtggcagcccaccctgcggcatggatcgaccaggtgcctagtgtataatacttgtggtatcgctctagctagcgcctgtattgaagggattagccttttgggagcataacagaaaggaggtcttcatttcatggtggtccataatttgttggagaatgtaacaaaaggaacgccgagaattcgatgccatggtattttcagactgttgctcgagtggtatggctggaaacgtatcatgcatcctatgaagtggacttgcattcaatcatggatgatcctatgaagtgtcggttaaccttggttgtgaccatctgattctgctgctgtctctgaagatggtgccttatattgaggccttccgagttcaaaccattctgtagtgtccagacatatttatccgtagtaatcagtttgcct

SEQ ID NO: 8586 - DNA, 1185 bp, Zea mays
tccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgctt

SEQ ID NO: 8587 - DNA, 953 bp, Zea mays
gaagctttcagccgatcgagcaccatcgtcacagtcagtagtagccaagcatatttctttctccgagtgatttgcgctgagcgatcagttcatccagagcgagcggagctgagctgagctgagcgagcttgcgttgcttgagagaccctgctgccatggcttcccaccaggacaaggctagctaccaggccggcgagaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggccgccaagcagaaggcagccgacgccatggaggccgccaagcagaaggccgccgaggccgggcagtacgccaaggacaccgctgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaaggactcctctaccatcaccagggatcactagacgcgtgtatgcacacgcacttggtccgatcctgtcgtccgtgaccctgtttgcttgttcgcgagtccagtatgggtttgtgcacgttttcagtgtcatggtttccttctctacgaaatttggtgttgtaagtttgattcgcaggtacgttgctgtgttttttctgcgtcatcatgtctgtaaacgagtcgggcgggtttgagtgtcctttgttgtgataataaagttggtaaatcgtaattaatatat

SEQ ID NO: 8588 - DNA, 886 bp, Zea mays
gtcattttcgtcacccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgttaaaaaaaaaaaaaaaaaaaaaaaaaaaaaaaaaaaaaaaaaaaaaaaaaaaaa

SEQ ID NO: 8589 - DNA, 2100 bp, Zea mays
gccagagagagatgcgggtgggagttgggatacctcggaggcggcgacgacaggatcgcagtggtcagtagccgggtcggccggtggccgcagattctcaccagcagcgccatccctcgccgtcgcccggcgctccagcccagggcaggagaggaagccactctgactctgtcactctgagcttcgcgtcacctgagtactgacggacgacatgggagaagttgaggacatgtacacccaagacgggaccgtggacatgaaagggaatcccgccgtgaagaagggcaccggcaactggcgcgcctgcccctacatcctcgcgaacgagtgctgcgagaggctggcctactatggcatgagcaccaacctggtgaactacatgaagacccggcttggccaggtgaactctgtcgcctccaacaacgtcaccaactggcaagggacgtgctacatcacgccgctcatcggcgccttcttcgccgacgcgtacatggggaggttttggaccatcgccatcttcatgatcatctacatttttggcctggcgctgctgacgatggcgtcatcggtgaaggggctggtgcctacgtcgtgcggcgacaaggacgtgtgccacccgacggacgcgcaggcggcggtggtgttcgtggcgctgtacctcatcgcgctgggcacgggcgggatcaagccgtgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacgtgggctggggctggggcttcggcatccccgccgtggtcatggccatcgccgtcggcagcttcttcgtgggcacgccgctgtacaggcaccagaagcccgggggcagcccgctgacgcgcatcgcgcaggtgctcgtcgcgtgcgcgcgcaagtggaacgtggccgtgcccgcggacaagtcgcggctgcacgagacggtggacggggagtccggcatcgaggggagccgcaagctggagcactcggagcagctggcgtgcctcgacagggcggccgtggtgacggccgaggacggcgcggaggcgagcccgtggcgcctgtgctcggtgacgcaggtggaggagctcaagagcgtgatccggctgctgcccatctgggccagcgggatcgtgttcgcggcggtgtactcgcagatgagcaccatgttcgtgctgcagggcaacacgctggaccagagcatggggccccggttcaagatcccctcggcgacgctgtccatggtggacactatcagcgtcatcgtctgggtccccgtgtacgaccgcgccatcgtgcccctggtgcgctcttacaccgggaggccgcgcgggttcacgcagctgcagcgcatgggcatcggcctcgtcgtctccatcttctccatggtggcggcgggcgtgctggacatcgtgcggctgcgcgccatcgcgcggcacggcctgtacggcgagaacgacatcgtgcccatctccatcttctggcagataccgcagtacttcatcatcggatgcgcggaggtgttcaccttcgtggggcagctggagttcttctacgaccaggcgcccgacgccatgaggagcatgtgctcggcgctgtcgctcaccaccgtcgcgctcggcaactacctcagcacggtcctggtgaccatcgtcacccacatcaccaccaggcacggccgcatcgggtggatcccggagaacctcaaccgcggccacctcgactacttcttctggctgctcgcagtgctcagcctcctcaacttccttgcctacctcgtcatcgccagctggtacaagtacaagaagacggccgatgattaccctggcgccaaaggggagcacggtacagagcactgatgggcgagagatggcggaaattgagtgatttctatgtgtggttagctgtctgcctgtctgtcgacttgttttgccacagtttgggtgcttaaacgttaacgtacgtactagttcaatatagtgtctcgggggcgaattggttgttt

SEQ ID NO: 8590 - DNA, 630 bp, Zea mays
cgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttc

SEQ ID NO: 8591 - DNA, 1809 bp, Zea mays
cccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 8592 - DNA, 1211 bp, Zea mays
acgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgccgcttcgtcggccacgagaaggacgtcatctccgtcgccttctccgtcgacaaccgccagatcgtctccgcgtcccgcgacaagaccatcaagctctggaacactctcggcgagtgcaagtacaccatcggcggcgacctcggcggcggcgagggccacaacgggtgggtctcctgcgttaggttctccccaaacaccttccagcccaccattgtctccggatcctgggaccgcaccgtcaaggtctggaaccttaccaactgcaagctgcgctgcactctggatgggcacggtggctatgttaacgccgtcgctgtgagccccgacgggtcgctgtgcgcctccggcgggaaggacggtgttactctgctgtgggatttggctgaggggaagaggctgtactcgctggacgcgggctccatcatccactctctctgcttctcacctaaccgctactggctctgcgctgcgacgcaggactctgtcaagatctgggacctcgagtcgaagcacgttgtgcaggacctcaagcccgacatccaggtctccaagaaccagatcctgtactgtacaagcttgagctggagtgcggacggaagcaccctctacactggctacaccgatgggtctatcagggtttggaagatctccgggtacggctacgcaggctagatgttgaaatcagcttggtctaggcagtctttcgggggaaaacattgtaatgtttgtcaagtttttgatgtcgtgagctatattgtctcttcgctactttccggtcgcccaaccattttaatcttactatggaagaatcttgttttgcact

SEQ ID NO: 8593 - DNA, 919 bp, Zea mays
cgagtgatttgcgctgagcgatcagttcatccagagcgagcggagctgagctgagctgagcgagcttgcgtcgttgcttgagagaccctgccatggcttcccaccaggacaaggctagctaccaggccggcgaaaccaaggcccgcaccgaggagaagaccgggcaggcggtgggggcgaccaaggacacggcgcagcacgccaaggaccgggcggcggacgcggcggggcacgcggcgggcaagggccaggacgccaaggaggccaccaagcagaaggcgtccgacaccggcagctacctgggcaagaagaccgacgaggccaagcacaaggccggcgagacgacggaggccaccaagcagaaggccggcgagacgacggaggcgaccaagcagaaggccggcgagacgacggaggccgccaggcagaaggcagccgacgccatggaggcagccaagcagaaggccgccgaggccgggcagtacgccaaggacaccgccgtctccggcaaggacaagtccggcggcgtcatccagcaggccactgagcaggtgaagagcgcggcggcgggcgccaaggacgcggtgatgagcacgctggggatgggcggggacgacaagcagggcgacgccaacaccaacaccaacaaggactcctctaccatcaccagggatcactagacgcgtgtatgcacacgcacttggtccgatcctgtcgtccgtgaccctgtttgcttgttcgcgagtccagtatgggtttgtgcatgttttcagtgtcatggtttccttttctacgaatttggcgttgtaagtttgattcgcaggtacgttgctgtgttttttctgcgtcatcaagtgtctgtaaacgagtcgggcgggtttgagtgtcctttgttgtgataataaagttggtaaatcct

SEQ ID NO: 8594 - DNA, 1156 bp, Zea mays
ctttttcaggcagtcccgtgattcctacagggggggaagaaagaggtggaacaacgcccggggcagagcagagatgatgcgggagacgtacatggacgtgctgccgccggtggaccacatagccgcacggagcaactggttcccggcggcggcgcgtctgtggacggcggcggagaacaagcagttcgagcgggcgctcgccgggctcgacctctgccgcccggactgggaggaggtggcgcgggccatccccggccggacggtgcgcgaggtcgtcagccacttcaagcacctcgaggtcgacgtccagcagatcgagagcgggcaggtgcccttgccggcctacggcggcggggccagctcgttcaccctgcagtgggacggctacggccccggtccgggggacttcaggcacgggtaccgcttcgccggaggctgcgggaggcggcaccacggccgcacgccggagcaggagcggaagaagggcgtgccatggacggaggaggagcacaggttgttcctcctaggcctgaagaaatacggcaagggtgactggaggaacatttcgcgcaacttcgtccagaccaggacgcccacccaggtggccagccacgcgcagaagtacttcatcaggctcaactccggcggcaaggacaagaggaggtccagcatccacgacatcaccacggtcaacctgacggacgaccagccgccctcgccgtcccagtcctccctaatcaccagccaatcgaacgcaccagctacagctccggccgcggggatatgccaggtcccattggcggccgacgccaagcgacacggtgccggaactctgcccttcagctcaccgaaccggacctctgcggcgccggcctacaggatggagtttcatgaccaacaaggcctgcagtgtggccctctgcatgatcagttgctcgccagccagagcgtcctgttctaggcgcggtggcagcccaccctgcggcatggatcgaccaggtgcctagtgtataatacttgtggtatcgctctagcttcagcgcctgtattgaagggattagccttttgggagcataacagaaaggaggtcttcatttcatggtggtccataatttgttggagaatgtaacaaaaggaacgccgagaattcgatgcc

SEQ ID NO: 8595 - DNA, 1617 bp, Zea mays
cgctacgtccgcgacccactcccacggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagacagctattggggtcggaacagtgggatcctcggaagcgatcatgcttgcaggtctggcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgcctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacggcgtcgtggccaagaaaagcgtgctggagatcgagcgggaggtcgccgcgcgctggatgaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggttt

SEQ ID NO: 8596 - DNA, 774 bp, Zea mays
cccagtcccaatcccaccagtgtccagtgctcggggaaccgacacagctcctcagcagagaagccagcccgatcagcagacagcaggcatggcgctcgcggaggccgacgacggcgcggtggtcttcggcgaggagcaggaggcgctggtgctcaagtcgtgggccgtcatgaagaaggacgccgccaacctgggcctccgcttcttcctcaaggtcttcgagatcgcgccgtcggcgaagcagatgttctcgttcctgcgcgactccgacgtgccgctagagaagaaccccaagctcaagacgcacgccatgtccgtcttcgtcatgacctgcgaggcggcggcgcagctccgcaaggccgggaaggtcaccgtgagggagaccacgctcaagaggctgggcgccacgcacttgaggtacggcgtcgcagatggacacttcgaggtgacggggttcgcgctgcttgagacgatcaaggaggcgctccccgctgacatgtggagcctcgagatgaagaaagcctgggccgaggcctacagccagctggtggcggccatcaagcgggagatgaagcccgatgcctagtagtggcgattgcgaccagtgtttaacccatgacgcagcgccgtcacagatgtcccgtgtggtcttgcgctttagcaatttctctctggagggagcgtgtattgttatcttgtgatcgagagcctgtgtgctgcctttgcttcttgtgattatatagctactgaataaagatgtagcgttcttcagcc

SEQ ID NO: 8597 - DNA, 1501 bp, Zea mays
gtcgtcttcaaggccatcgacaccaagactggaaatacagtcgcggtaaagcgaatccggataggaaaggacaagaaggaaggtgtcaacttcactgcgttgagggaaattaaactacttaaggagctgaaagatcctaatattatagagctgattgattgtttcccttacaaggaaaatttgcaccttgtgtttgagtttatggagaccgatctggaagctctcataaaagataagaacataatactctctccagctgacacaaaatcatatgtccagatgatgttaaaaggtctagcgttctgccataagaaatgggtgctacacagggatatgaaaccaaataatttactcattggtgccgatgggcagctcaagcttgctgacttcggtctggcccgtgtgttcgggagtccaggaaggaacttcacttaccaggtctttgcacgttggtaccgggcaccagaattattatttggctcgaagcagtacggatctggggtggatatttgggccgctggatgtatttttgctgaactgcttactcgcagagcctttctccagggttctagtgacattgatcaacttgggaagattttcgcagcacttgggaccccaaaatcttctcaatggcctgacatggtttatcttcctgattatgttgaataccaatatgttgctgcacctccactacgtacgttgtttccaatggccagcgatgatgctttggatcttctgtcaaaaatgcttacctatgatccaaaagcaagaatcagtgctcagcaggctctagaacacaggtacttttcatcgttacctgcaccaacaagaccatcgcagcttccaaggccacgtcggaaaggagatcaagggaataacaagattcctgatctcaacctgcaggatggccctatggtgctctccccgccaagaaagttacgtagggtgacagcgcatgaagggatggaaggtatgcacaggacagataaagtggacgaacatccttctgggatgaggcacaccgatgacatgcccagtcagagttctagaattccaatgtcagttgatgttggggctgtgtttggcacacgacctgcacctaggccaacattgaacagtgcggacaagtctcgtttaaaacggaaacttgatatggatccagagtttggatacgcggagtagaaggaacacatgtttacatgcaccattcttttcttattggggatgttgatttttaaaataagattctgacacaatcaactgagatgttaccgtcatcgcctcacgaagaggaaaactgaagagagattattctaatttatcccgagtcacatagggtattacagctaaccaattccgtaaggcaggctcttgaaaacagtagactcaatgggatattcatgagtggagagtgttatggggaattggaggatggaaaagcttgctccatgcgtgtttgtacgtgttttgccaagattgtgctgaagcatctgatctatct

SEQ ID NO: 8598 - DNA, 786 bp, Zea mays
tttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 8599 - DNA, 845 bp, Zea mays
gccacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagtttcctgtacttgtggggtgaatttgtacgtgtgatacggtaacttggtccgtgtactgtttatgctgctacgttttccttcctaaaagtacgtatatatatacagcacttgcgagtggcttt

SEQ ID NO: 8600 - DNA, 725 bp, Zea mays
ggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttgcccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 8601 - DNA, 852 bp, Zea mays
gccacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagtttcctgtacttgtggggtgaatttgtacgtgtgatacggtaacttggtccgtgtactgtttatgctgctacgttttccttcctaaaagtacgtatatatatacagcacttgcgagtggctttacttgtg

SEQ ID NO: 8602 - DNA, 838 bp, Zea mays
cacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagggacagtttcctgtacttgtggggtgaatttgtacgtgtgatacggtaacttggtccgtgtactgtttatgctgctacgttttccttcctaaaagtacgtatatatatacagcacttgcgagtggcttt

SEQ ID NO: 8603 - DNA, 743 bp, Zea mays
ccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttgaattgc

SEQ ID NO: 8604 - DNA, 1473 bp, Zea mays
tcaacttcgatggactcgccaaggctttgacaccaggtgcaacgatatttgtgggccaatacttgttcactggtagcgagactacttcagtttggttggaggtttctgaagttaaaggagatgatgtggtttgtatcatcaagaacacagctaccttggctgggtcgctcttcacgctgcattgttcccagattcatattgacttgcccacgctgtctgatgaggataaggatgttatcaaaaaatggggtgctccaaataagattgacttcctctctctgtcttacacaagacatgcagaagatgtgcggcaggcacgtgagttcctctcgaaattgggtgatcttagccaaactcagatctttgccaaaattgagaatgttgagggtttgaaccattttgatgaaatactggcagaggcagatggtatcattctgtcaagaggaaaccttggaattgaccttccacctgagaaggtctttttgtttcaaaagtctgcgcttcacaagtgcaacatggctggaaagcctgctgttgttactcgtgtcgtggacagcatgactgacaacctcagacctactcgcgcagaggcaactgatgtggcaaatgcagttcttgatgggagtgacgccattctccttggtgctgagactctccgtggtttatatccggtggagactatttcaacagtgggcagaatttgtgctgaggctgagaaggtattcaaccaagatttatactacaagcggactgtgaagtatgtgggagaacctatgacccacttggagtctattgcttcttcagcagtgcgagctgcaatcaaagttaaggcatcagtcatcatttgcttcacctcttctggacgagctgcaaggctcattgctaagtacaggcccagcatgcctgttctatctgttgtcattcctcgtctaaagacaaaccaactgaagtggagtttcacaggtgcttttgaggcaagacaatcactcatagttagaggcctcttccctatgcttgctgatccacgacacccagctgaatctaccagtgctacaaatgagtctgtgttgaaggttgctcttgaccatggcaaagcctcgggcgtgatcaagtcccacgaccgcgtcgtcgtttgccagaaagtgggtgattcctctgtggtgaagataattgagctggatgattagacaatcaggctatgctgttgtctactagggcacgttttgccattttttttttgcctaggccgaaacttattggctatgtataatcctatagcgcttgaaaactgagcagtttttcctatggtgccatcataggatttgcttttacagttcaattatggtgtagttcgaaatttgctcgactaaactgcggtgtaacagttaaatgggcagatggaataatgtaatcatactgttccctcgttaggttgtcacttgaattgatgacctggcctctttttttttggct

SEQ ID NO: 8605 - DNA, 958 bp, Zea mays
agatggttgagtatatggagaaggtggctaagactgtagatgtggaagagctcactgttgaggagcgtaacctcttgtcggtcgcatacaagaatgtgattggggctcgccgtgcttcatggcgcattgtctcttctattgaacagaaggaggagtcccgtaagaacgaagagcatgtgaaccttatcaaggaataccgtgcgaagatcgaggctgaactgagcaatatctgtgatggcatcctgaagctgcttgactcccacctagtgccttcttctactgctgctgaatcaaaggtcttctacctcaagatgaagggtgactatcacaggtatcttgcggaatttaagactggtcctgagaggaaggaatctgctgagagcacgatgatggcctacaaggctgctcaggacattgcgctggctgagctggcacctacccatccgataaggcttgggcttgctcttaacttctcagtgttctattatgagattctgaactccccagacaaagcttgcaaccttgcaaagcaggcgtttgatgaagctatctcccagttagacacccttggggaggagtcatacaaagatagcactctgatcatgcagctcctgagggacaacttgaccctttggacctctgacctcacggaggatggtgctgatgagggcaaagaagccccgaaaggtgaggctggtgacggacagtaagggacagtaatcttgggagagcgcatattgttcgagcccattgttttagatgctctatgctgtcgaagctgaagctgtgccgtgctattattgtagctgatttcctgttccctcactttttttttatattagtaggctggtagtgttcgaattagttccccattgctttgtgttgccgctagctgtcactaagtccgtgtggactggtattattcactggatttgagaagcatgtcagtggttgctct

SEQ ID NO: 8606 - DNA, 1004 bp, Zea mays
cgagttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggagaagacgggtcaagtgatgggggcgacgcaggagaaagggagggaggccaagcacaaggcgtccgacgcctccgaccgcgccatgggaatgggccacgacgccatggaggcgaccagggagaaggcgcgcgccgccgcggaccgaaccatggggatgggccacgacgccggggaggcggccaaggacagggcgtaccgggccaaggacgcggcctccggtgccgctggccgcgccagggacactgcgtccgacgcggccggcgctgccggggaccgcgcccgcgacggcgcgcagcagaccgggagctacgtcgcgcagacggccgaggccgccaggcagaaggcggccggcgccgcgctgtacgccaaggacaccgtggtggccggcaaggacaagaccggcgccctcctgcagcaggcaggggagaaggtgatgagcacggccgtgggggccaaggacacggttgtcagcacggccgtgggggccaaggacacggttgtcagcaccgccgtgggagccaaggacgcgatgatgaactcgctcggcatggccggcgaggacaaggacggcaccaccaccaccgacgccggcaaggacaccagcacccgcaagcctggcagggactattagaggacacggcagccaaacttctcagtgtttctgttccagaagtttctgatcccatcatttaggttcaaaagtttctcatttcatttcaaactttcagtgtttggtgcatgctgtaaactctcttcaggacgggtcgtttgacatttgtgtcgactgaagcctccgcgctttcgactcaacgatgtatatgtaataataaagtcgcaaagctgttgttttatttt

SEQ ID NO: 8607 - DNA, 843 bp, Zea mays
cacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagggacagtttcctgtacttgtggggtgaatttgtacgtgtgatacggtaacttggtccgtgtactgtttatgctgctacgttttccttcctaaaagtacgtatatatatacagcacttgcgagtggctttacttg

SEQ ID NO: 8608 - DNA, 1034 bp, Zea mays
gccaaggtgcgacgacggcggtcgcagcgtcccctccctccctccgtaccgctgccgccggtctaccaaaaggtgaaatatttacgcaagcgaaatcagtgtcttgaagatagcttccagatatgtggggttttgcatcaaatgcttgggcatccgggctggggaagaggagtcccccaaattgcacctcttcgagtgctgcttgttccgatgacgaagcatcctcgtgcacgagcagggaagaaggcctggaatgcccaatatgttgggagtctttcaatatagtggagaatgtgccttacgtgctatggtgcggccacaccctttgcaagaactgcgtcctaggacttcaatgggccgtcatcaaagttccaactgtgccgatgcagctacccttcttcgtttgctgtccctggtgcaacctcctgtcgcttcgcatactttacaaagggaacctcacgttcccacggaagaactatttcctcctctggatggttgaggggatgaatggtgagcgggccagatcacgcccagctactcacagcgagcaacatactccatggctctcaagcagcagcagagcaaatggaaatgcaggctgctcaaatcccacaagacgccaccttccactgccaccgccggttgacactacttcgcccaccaatgcaaatcatgccaaccatggggtccctgtccctctgctgaacgcagagagggtacaggcttcgctgcgcaagtccttgtcgttcctggttcacctgacctccaagtttcccctggtgttcatcttcctcctcatagtgctctatgcgatccctgccagcgcagcagtcttgctactgtacatccttatcacggtgctgttcgcgctcccctcgttcctgatactgtatttcgcgtatccgagcctggactggcttgttagggaaatctttgcctgagatttccttgttcggtaaaatctcaatgctgttgttgagtccttgtataactgaaccttccctagatcttgttgcaagcgtggatgctattgc

SEQ ID NO: 8609 - DNA, 788 bp, Zea mays
gcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttg

SEQ ID NO: 8610 - DNA, 942 bp, Zea mays
ccacgcgtccggtcgccctttgttggaaggaacgatggagcagaccttcatcatgatcaagcccgacggcgtccagcggggcctggtataatataatcagctgcttggtttttttccccgtttattttccataggagagtctgatacaggagggtctctgttgatcccagctgcccggcggttttatgtttgttcgcgaggacaagttctggtttcgtttgggtttccgcgtcatgtttcacgcttggtgccagcttttaactcgcagtttcttgcgcagatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaaaaaaaaaaaaaaaaaaaaaaaaaaaaaaag

SEQ ID NO: 8611 - DNA, 956 bp, Zea mays; identical to SEQ ID NO: 2484

SEQ ID NO: 8612 - DNA, 836 bp, Zea mays
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8613 - DNA, 825 bp, Zea mays; identical to SEQ ID NO: 8321

SEQ ID NO: 8614 - DNA, 820 bp, Zea mays
cacggattcgcttgtccacctgacgaaccgcggcaaaagcgccaaaacccatcccaccatccaaacccgatttgacgtctccaacgcactcatcccccgaaattcctcgcctcgcgcccaaagcacgactcaaaaatttccccatctccccccgcgcactctcccaaatcctcccctttaaacccacctcaaatcctctcctacgccgcaccgaattcgagacctccaattccctcgtagcagcagcaccagtagagtctccttcctctccggcggcgatgtctgggcgcggcaagggcggcaaggggctgggcaagggcggcgccaagcggcaccgcaaggtgctccgcgacaacatccaagggatcacgaagccggcgatccggaggcttgcgaggaggggcggcgtgaagcgcatctccgggctcatctacgaggagacccgcggcgtgctcaagatcttcctcgagaacgtcatccgcgacgccgtcacctacactgagcacgcccgtcgaaaaaccgtcaccgccatggacgtcgtctacgccctcaagcgccagggccgcaccctgtacgggttcggcggctaagcgcgccctgtccatctgggggtgggcctggtactggtggcgcttctcctttgggttccctgttctgtgctttccattctgtgggaaggtaccggattcctagatctatgtttcgatccggtgtttggtggtccatgtgatgtcgtgtagtagtacaaagagttccaactcctagttgtatcttagttgtttcctttgcagaaatgaaatgataactacgattgcctagc

SEQ ID NO: 8615 - DNA, 1557 bp, Zea mays
gttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacttggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 8616 - DNA, 1600 bp, Zea mays
cgagagcgtggagagtcgagagcccaccacccgcgacctaacccggtgacctctctcccctcccaggctctcccacccacctttctcctctccttcattcctccccgtcccgcgtcgcgtcccacgccgccgcacctccgcggcagcgctactcctcgccgtgacgtcggggaggcctcgctcgggggagggctgcctgcctgcctggctgggtgtcagtcggccgtagaggaggaggggggcggaggagcttgatctggggcacctgccccccctcccctgcgccgtcgggatgtacatgccgccgccgccgcccaccggcggcgccggcgagcagcctaggctttaccaggtctggcggggaagcaacgaattcttcttgcagggaagattcatatttgggcctgatgtgagatctgtgtttctcactatgatcctcatcatcgcaccagtggttgtcttctgtctgtttgttgcaaggcatctcataaatgatttccccgatagctggggaatctcagtgatggtagtagtggttgtcttcactatttatgatttgacgttgcttctttgtacctctggtagagatcctggtataataccccggaattctcatcctcctgaacctgaatccattgatgggatcaacgacacgggtgttcagactccacaacaatttcgtttgcctcgcacaaaggaagtaattgtaaatgggatcagtgtacgggtcaaatactgtgatacttgcatgctgtaccgaccacctcgatgctcacactgttccttttgcaataactgtgtggaacggtttgatcatcactgtccatgggtcggccagtgcataggactgcgtaattatcggttcttctatatgtttgtattctcgacgacattgctctgcctctatgtatttgccttctgttgggtgtatgtgatcaagattagagctgctgagcaatcgtcagtttggaaggccttgctgaagacaccagcatcagttgctctgattatctactgttttctctgtgtatggtttgtgggtggtttatctgtcttccatttatacctgatgagcactaaccagacaacatatgagaatttcagatatcgctatgatcggcgcgataacccatataacaaaggtgttctgaacaattttctagagatattctgcactgctatccccccttcgaagaacaatttccgggcaagggtgacagcggggcaagggctgcagcaaacgcgctcacagtccaggggtttcatgagccccagcatgggcaagcccattggagatcttgaaatggacaggaagccagtagcaccttgggacgagccaaggacggcggctgatatcagggacttggaagcagggcttggggtcatgttcgatgagaaagagggcagggtagctcatgcatccccagatctgagcagagaccttccagcagagttcgtggaaggccgatctggtatgcactcgaggcagtcaagctgggttcagagaggagacgcaatcgaagcgtcggcggtgcaaatggctaatgcgcgcaccacggaagctagcaacaatgttgcctggagcggtacacattaaccc

SEQ ID NO: 8617 - DNA, 1025 bp, Zea mays
gctagctgctttattataagtagcagctgcagcaggtaggagctgcacacacccatccaattccagctgctgatcttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggcccaccagctgagcccgccggcgatcgccatcgtggtggagtgcgtgttcgcgccgttcctgggccgcgagcgcaaccaggcggtggtggacgagaacgtggagaagctcaagaaggtgctggaggtgtacgaggcgcggctggccacgtgcacgtacctcgccggcgacttcctcagcctcgccgacctcagccccttcaccatcatgcactgcctcatggccaccgagtacgccgctctcgtccatgcgctcccgcacgtcagcgcctggtggcagggcctcgccgcgcgcccggcggccaacaaggtggcgcagttcatgccggtcggcgccggagcgcccaaggaacaggagtgacgatgaagcgatcgaagcgacttgtgttgttgtgcttgattagttaattggaaaccttctcactcatctagtccatcatggtgcctgcttttctttatactatttgtcttaattttgctgctttctccacggaataatagtagagatttggaaatgtaatgtattttatcaaaatatattggattttcaagc

SEQ ID NO: 8618 - DNA, 1793 bp, Zea mays
ctcctactacgatctggtggttcttgttttccggagaaaaaaaagcggaggccatcttgctagggttccagcacttcgtcgtcatgctgggcaccaccgtcatcatacccagcgcgctcgttcctcagatgggaggcggaaatgaagagaaggctcgggtggttcagaccatactgttcgttgctggcataaacaccctgttccagacgttattcgggacgcgccttccggtcgtgatgggcggctcgtacgtcttcgtcgggccgaccatctcgatcgtcttggctggacggtacagcaatgaagcagaccctcacgagaaattcctgcggacgatgagggggacgcaaggcgctctcctcgttgcgtcgacgattcagatcatacttgggttcagtggcctctggcgcaacgttgtcaaattactgagtccgctggcagctgttcctctggtatcactggtcgggttcgggctctacgagcttggctttccaggggtagcgaaatgcgtcgaagttggcctcccagaactgctcctgctggttgtgttttctcagtatctgcctcaggttctggacttcggcaagtccgtcttcagccggttcagcgttctcttcaccgtcgccatcgtgtggctgtacgcctacatcctcaccatcggcggcgcttacaagaactctccgcccaagacacaggtgcattgccgcgttgataggtcgggccttatttcaggagcaccttggataagtgttccctatccctttcagtggggtgctccgacgtttgacgccggagaagctttcgctatgatgatgacttcgttcattgctcttgtagagtcaactggcgccttcatcggtgcttcgagatatgcgagtgcaactatgattcctccatcgattatcagtcggggcgtgggatggcagggcattggtctgttgctcgattcatttttcgggacagcgaacgggacatcggtttcagtagagaatattggactgcttgcgttgacacgcattggcagccggagagtggtgcagatatctgcaggcttcatgattttcttctctgtccttggaaaatttggagctttgtttgcgtcgattccgctgcccgtatttgccggcatgtactgtctcttcttcgcatatgttggtggcgttggcctgagcctccttcagttctgcaacctaaacagctttaggaccaagttcatcatggggttcgctttcttcatgggcctatcggttcctcagtacttcaacgagtacacagccgttgcaagctatggtccggtgcacactggcgccagatggttcaatgacatgatcaacgtgccattcacgtcgaagccgttcgtcgctgggttggtagcctatatcctggacaacaccctccaggtaaaggagagcgcggtgcggaaggacaggggcaaccactggtgggagaagttcaggagcttcaagaaagacgcgaggagccaagagttctactcgctgccgttcaatctgaacaagttcttcccgtcggtctgatctcaaatggcgccgccgctgaatcaattctggaagcaacccttgttcatatgggcgttaatgaggaacataattctgctggtctggccagtggaagcttctgtgtctccattgttggtcaattttgtgtgttttcggacgagatgggagtaattgaactgtagaaattattacgattgaagtatatcgcgttctttttgtaatctacatgaatcagcgcagattaaatatttgtaggcgtagatactttgatcagtc

SEQ ID NO: 8619 - DNA, 1596 bp, Zea mays
gcgagaagcagggagtgcgctcgacggccgccgccattagtgatttagtgttgaagagggagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgcttctgcaccacgccgccgcggccccgtcgtcgtcgcagcagcagcagcagcaccaccaccaccagtacgccaggcacggcgccgagatgtcggcggcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcagaaggtgttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccatcggaggacatgcctttcgtgatgatggaaggcttccacccgcagaacgccgctgctctgtacatggacgggccgttcatggccgacggcatgtatcgcctcggttcatgaactacacacttccatggacgactgtggggcctatccaatcgtcggaccgtgggagtatatttcagtgttgcggtgcaaggacattgttgtggaatttttgttgctgattgccaaggggtgggtcggtcgatgtagcgtctatgcatggcttgtagttctcctgtaatgttgttgttaatttccgcttggcggcttgtaatctaggtgtatctctggaacttgaatcctgggtgattaatccggcaagcagctgcctgtttgtatgattgtatggttcgggttggtggaacatgatgcatgctaaggcgtggcctgtctggatcaaaaaaaaagaagatgtcttttgtaccagtggaatgattggaacttcagattgctgaacatttccgatct

SEQ ID NO: 8620 - DNA, 1238 bp, Zea mays
gcctgaagaacttttgccacatggcagttctttgccttgggaaggatttcactatatcacaaaccgtgtgatggattcatctcttattgattcagagaactctatgcctgggtgtgcatgttctcatcctgaatgttctcctgagaactgtggtcacgtgagtctctttgatggtgtctacaatagcctggtggatatcaatggaacaccaatgcatggcagatttgcatatgatgaagatagtaaaattattttacaggaagggtatccaatatatgagtgcaattcatcatgtatttgtgactcgtcctgccagaataaagtattgcagaaagggctgcttgttaggttggaactctttagaagtgagaataagggttgggctattagggctgctgaacctattctacagggtacctttgtctgcgagtatattggtgaagttgtgaaggctgacaaggctatgaaaaatgcagaaagtgtgtcatcaaagggtgggtgcagttacttgtttagcattgcttcccagattgatagggaaagagttcggactgtaggggctattgaatactttattgatgccacaaggtctggaaatgtttcccgttatattagtcacagttgttccccgaatctcagtacccggttggttttggtagagagcaaagattgccagcttgctcacattggattgtttgctaatcaagatattgccgtaggagaagaactcgcctatgattaccgacaaaagcttgtagcaggcgatggctgcccatgccattgtggaactaccaattgccgaggccgtgtctattgattttgcaggaatacactaactgttcaatgctcggttgcagaactccagagatttcaacagttgtgtaggcttgctgagcgatttagcattgcaattttcctacagcttgagtgcagggctaggatctcattgttaatgctacaaatagtgattgtgatataggactcaggcaagcattaggcaataacatagtgtcgattttagtcatggtaccatcatgtttaactgattatttgttagaagcagcctgaaatgaaactgattcaggctgctctgttcgtaggcgagaattctctctgtaaaattccttcatattttatggttcatgagcaccatcattgacgtgaagtaataaactagttatcccagtggcctattgtgcggataatactccctctgttttttttagggagcgacaaat

SEQ ID NO: 8621 - DNA, 825 bp, Zea mays
cgtcacccctgacgctcgacgcctctcctcctctcctcccccacccgtccatcgcccctccctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgtt

SEQ ID NO: 8622 - DNA, 1781 bp, Zea mays
ctcgtctccagagttcagaccaccgcatcgccatggcgccgccgcagacgatcccccggcgcggcctcttcattggcggggcctggagggagccgtgcctcgggcgccgcctgcccgtcgtcaacccggccaccgaggccaccatcggcgacatcccggcgggcacggcggaggcactggtcgcgcgcccctggggccgtgcgcgccaacttcctccgggcgatcgccgccaagattaaagacaggaaatctgagctggctttgctggagacacttgattctggaaagcctctggatgaagcaagtggagacatggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggaccatgtttgggatcttcgcgaatgctggtcaagtctgcagtgctacttctcgtttactgctgcatgagaaaattgcaaagaaattcttggatagattggttgcatgggcaaagaatataaaagtctcagatccactggaggaaggctgcagactgggttcagttatcagtgaaggacagtacgagaagataaagaaattcatctcgactgcaagaagtgaaggtgccacaattctgtatggaggtggccgaccacagcatctcagaagagggttctttcttgaacctacaattataacagatgttagtacgtcaatgcaaatttggcaagaggaagtctttggaccagttatctgtgttaaggagtttaggacagagagtgaagctgtggaacttgcaaatgatactcactatggtttagctggtgccgtgatctccaatgatcaagagaggtgtgagcgcatttcaaaggctcttcactctggtattatttggataaattgctcgcaaccatgcttcgtccaagctccttggggagggaacaagcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctgcactctttatcattcgaagtttggcagtggtgtgtagttgcacttggaagattgcaataataataaagataattggataattgatcc

SEQ ID NO: 8623 - DNA, 1971 bp, Zea mays
gttggtggggtcattagcggagctgtgtgaggcgacgatggggctgggggctgcggtggcgctggcgctgggcgacccgccggcggactacgcctccatcgcggcggtggggctgttcgtggcgctcatgtgcgtctgcatcgtcgtcgggcacctcctcgaggagaaccgctggatgaacgagtccatcaccgcgctcttcatcgggctgggaactggagcggtcatcctgttcgcgtcgagcgggaagcattcgcgcgtgctggtgttcagcgaggacctcttctttatttacctgctgccgccgatcatattcaatgcagggttccaagtgaagaagaaacagttctttcgaaacttcattactattacactgtttggtgcagttggcaccttgatctcttttactgtaatatcccttggcgctctaggactaatatcaaggcttaatatcggcgcacttgaactgggagactatcttgcacttggggcaatattctcggccacagactcggtttgcaccttgcaggtgttaagccaagatgagacaccattcttgtacagcctcgtgtttggtgaaggtgttgtcaatgacgcaacttctgttgtgttgttcaatgcaatccagaactttgatcctggaaatatcagcagtgccaaattactgaacttcattggcagtttcctttatctgttcggctccagcaccattcttggagtagcttctggacttcttagtgcttataccattaagaagttgtacttcggcaggcattcaaccgatcgtgaagtttccattatgatgctaatggcttatttatcttacatgctagctgaattgctcgatttgagtggcattctcactgtgtttttctgcggtatcgtaatgtcacactatacttggcacaatgtaacagaaagttcgagggtcacaaccaagcatgcctttgcaacattgtcgtttatctccgagacttttctgtttctttatgttggtatggatgcattggatatagagaagtggaagattgtcggtcaaacttatagcccggtaaagtctatcgctttgagcagcaccattttagccttggtgctggtttcaagagctgcttttgttttcccactatcctttgtatcaaatttgaccaaaaaaactccaaatggaaagatatcttttaggcagcaggttattgtttggtgggcgggtctcatgagaggtgctgtgtctattgcgttggcttacaataagttcacaagatcaggccatactcaacaacctagcaatgctatcatgatcacaagcacaatcagcgttgttcttttcagcacaattgtctttgggctgctgacgaagccactgatcaggctcttgatcccgtcaaggcacctatccagggaaccaagcgccctttctgaaccttccagcccgaagtctttctttgagcagctggccgccaacagccctggacacccggatcttgagaatggcataagcctacgacgcccggcgagcctccgttttctcctagtaagcccggcacggtccgtccaccattactggcgcaagttcgatgacagtttcatgcggccggtgtttggtggccgtggcttcgttcccttcgtccctggttcacccactgagagcagcttgccattgcttcctggcaatgagaactgaaaccagcgtatcgaggggctttaattcagcagaagttttgtaaattggcttcgcttatggttataatattttgtgtaaatctaggtttgtagattcaacttggtagcatgtacatgttgatgtaggctagttaactgaccagcgaccaaacggctgtgcatattgatatctcgtcgctctcaatgagtttgtatttataaaatactctgtacatcggatcactaaatatgtatcgtctccaacttaataaatactcatccgttctaaaataatattagtcgttttagatttcc

SEQ ID NO: 8624 - DNA, 2199 bp, Zea mays
attctctcctctgttcccactcattaagatcccaccgcctcccgccggccgccgccgacgagcaccgcagcctgacacagagccgcgggcgagccatcgcgtgcggcctcgcccgggatggcgaccatggagagcctgatcgggctggtgaaccggatccagcgcgcgtgcaccgtcctcggcgaccacggcggcggcggcggtgagggctccctctgggaggcgctcccctccgtcgctgtcgttggcgggcagagttccgggaagtcgtcggtgcttgagagcatagtagggagggacttcctgccccgtggatctggtatcgtcacgaggcggcctttagtgctgcagctccacaagacagatggtgggcacgagtatgctgagtttctccacgccccgcggaagcggttcaccgactttgctgctgtgaggaaagagattgctgatgaaacagaccgcattactgggaaaactaaagctatttcaaatgttcccatccatttgagtatatattcgccacatgttgttaacttgacacttattgatcttcctggactgacaaaggtcgctgtagaggggcaagcagaatctattgttcaagatattgaaaacatggttcgatcttatgttgacaagccaaattgcatcatcttggctatctccccagctaaccaagatatagcaacgtcagatgctatcaagcttgccagggatgttgatccttcaggtgacaggacatttggagtcttaacaaagcttgatttgatggacaagggtaccaatgctgttgatgtacttgaagggagacaatatcgcttacaacacccctgggttggaattgttaatcgctcacaagctgatatcaacaagaatgttgatatgctttcagcaagacgcaaagaaaaagagtactttgagagtagtcctgaatatggtcacttggcacataaaatgggtgcagagtatcttgccaagcttctgtcacagcatttagaggctgtgatcagggccaaaattccaagtattatagccttgattaacaaaacaattgatgaaatagaagcccagttggatcgacttggtagaccaatcggaggtgatgctggggctcagttgtacacaatcttggatatgtgtcgtgcatttgaccgtgtctttaaagagcacttggacggagggcggccaggtggagatcggatttatggtgtctttgacaaccagttacctgcagcactgaaaaagcttccatttgaccggcatctttcaatgcaaaatgttcgtaaagttatttcagaggctgatggttaccagccccacttgattgcccctgagcaaggatacagaaggcttatagatagttctttaagctactttaagggtccagctgaagcgtctgttgatgcggtccatttggtcttaaaagagcttgttcggagatcgattgcagcaacagaggaattgaagcgatttccaacacttcaatcggatatagcagctgctgcaaacgaaagcctggaaagattccgcgaggatggacggaagactgttcttcgtctagtagagatggaagccagctacctaacagtagaatttttccgcaagcttcctactgaaccagagaaagcggctgataagaacactccagtgagtgatagatatcaggacaatcatctcagaagaataggatcgaatgtgtcatcttatattaacatggtctgtgagactctgaggaacacaattccgaaagccgtcgtacattgtcaagtgaaagaggcaaaaagaaatttgcttaaccgtttctatgctcatgtgggaagcaaggagaagaaacagctgagtgcgatgttggacgaggaccccgctttgatggagaagagggatgccctggtcaagaggctagagctgtacaaatctgcaaggaatgagatcgactctgtcgcatggaaatgattggcttgtggcagccactggtggatcgtagaatgtacaaccgcagcagcacacgtatggattgcagtagaatgatcaattctttttttacatttgaatttaccctggaggccttgcacgtgattttcgcgagtcttttgccgaacacatgcttatttggccgtcttggctcattcacgcgattgtgttatgggaggatgttctggtctccagttgatataagagtatatatgtattcttttgttg

SEQ ID NO: 8625 - DNA, 1107 bp, Zea mays; identical to SEQ ID NO: 8212

SEQ ID NO: 8626 - DNA, 2070 bp, Zea mays
cgccctccaactccgggctccgcaaccgctgctccccctccctccctccctccagctcggcctgcctcagcccgcgccgcgcgatgtcagaggaggacgaggaccagccgccgcccaagcggccgtgcgcgtcgccgcccgcggaccaggtgctcgacaacgtgctcgagacggtgctccagttcctggacgccccgcgggaccggagcgccgcctcgctggtctgccgctcctggcaccgcgccgagtccgccacccgcgactccgtcgccgtccgcaacctcctggccgcctcggccacccgcgccgcgcgccgcttccccaacgcgcggagcctcctcctcaagggccgcccgcgcttcgccgacttcaacctcctcccgcacggctgggacgcctccgccttccgcccctgggccgccgccgtcgccgcggggtccttccccgcgctcacctcgctctacctcaagcgcatccccgtcaccgacgctgacctcgacctcctctcccgcccgctcccggcgtcattccgcgacctcacactgcacctctgcgacggcttcacctcgcgcgggctcgcctccatcgcctcccattgcaggggcctgcgagtgctcgacgtggtggagtgcgacatggccgaggagcaggaggtcgtggactgggtggccgcgttcccgccggagcccaccaacctggagtcgctctcgttcgagtgctacgagccgcccgtggccttcgccacgctcgaggcgctcgtggcgcggtccccgcgcctcagccgcctgggggtcaacctgcacgtctcgctcggccagctgcgccgcctcatggcgcacgcgccgcgcttgtcgcacctgggcaccgggtcgttccgcccggcggaaggcggcgaggaggaggcagagttcggggaggttgtctctgcattcgtgtccgctgggcgagcgcgcacgcttgtttctctctccggcttccgtgacctcgcgcaagagtacctgccaatcatcgacgtggtgtgctcccacttgaagagccttgacttaagctacgccgcggtcaccccgaatcagatcctgatgttcatcgggcaatgctacaaccttgagacgctatgggtacttgactcggtgcgtgacgaagggctcgacgccgtggggatttactgcaagaagctccagactcttcgcgtgctcccattggatgcgcatgaggatgccgacgagttggtatcggaggttggccttactgccatcgcacggggctgccctgctctccgttcaatactatatttttgccagacaatgaccaacgctgctgttgtcgacatgtcgctccactgcccggagctcaaggtattccggttatgtataatgggacgacaccagccggaccatgcgactgaggagcccatggatgaaggattcggtgccattgttaagaactgtaggaagcttaccaggctatccacgtcgggtcaacttactgaccgggcgtttgagtacattggcaggcatggcaagtccctgcggacgctctctgtagcgtttgctggaaacagcgacgtggcgctgcaatacatcctccggggctgctcaaagcttgagaagctggagataagggactgccctttcggtgatgccggcctactctctgggatgcaccatttctataacatgcggttcgtctggatgtcaggctgcaacctgaccctgcgggggtgcaaggaggtggctcgggggctaccacgaatggtggtggagttgataaatggccagcctgatgagaacgagaggaaggaaagtgtggacatcttatacatgtatcggtcactcgatggtccaagggaagatgtaccaccatttgtgaagatcctgtgaagctgcttctggtagtatcatgctgctgcccttgatatgctagttgagtgcagatcatttaacggaatatatgtaagatgttgggctgcagatatggtacaattttttttatctcttcaaattcttaggaggatttccaaagcactgtaatggagcggcgggcagggtgttcaattgacgttgttgttct

SEQ ID NO: 8627 - DNA, 538 bp, Zea mays
gcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaaatcgtgtgaatgggaatggatctc

SEQ ID NO: 8628 - DNA, 733 bp, Zea mays
gtaccccgcctcccggttcaaccaaatccctctcgcctcatccccaccagcgcaaagccgccctatcgtcctgtcgtgagaagcaatggcgggccgtggcaaggcgattggcgctggtgccgcgaagaaggcgacgtcaaggagctccaaggctgggctgcagtttcccgtcggcaggatcgctcggttcctcaaggccggcaagtacgccgagcgcgtgggcgccggcgcccctgtctacctcgccgctgtcctcgagtacctcgccgctgaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcgttatgcccaacatccaccagcacctcctccccaagaaggctggctcgtccaaggcttccaccgtcgatgacgatgacaactgaagctgcccactggagaagaggcattcgctaccgtcttgtttcctaggtttagcacgcagttagtcagcatgtctttgagagctcgatgtgtttgggaatgacaatagctcctttcttggttccctaagatcgttgattcagatgtgaatacggctaaggtttttgggctatgcaactctgggacgtacgccagttgatttgatcgtttgaaaagaaatggaaggacgttaaagcttgaac

SEQ ID NO: 8629 - DNA, 1358 bp, Zea mays
ctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacgag

SEQ ID NO: 8630 - DNA, 835 bp, Zea mays
gtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8631 - DNA, 798 bp, Zea mays
ggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8632 - DNA, 1260 bp, Zea mays
catccgtccaccgggtagggtttctccagaattaaaagggccgaaggaggcgcccttaaaaacccttccattcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggacatgttttttctgagttct

SEQ ID NO: 8633 - DNA, 1387 bp, Zea mays
cctcaagtccagtccagccggatcagtccccttcccctcctccacaaggcgccgcctcccgcagatccgaattggaatctgggccttcgtctccgcaccacaaatccggaaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcaaagcaagccggagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggggcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgactactactacgccgtcggcagcgacgacgacgaggctatctgggacgacgcgcagggcctggagaacctcgaggtgaggttctacggcggtggcggcttcggcgagagcttcgccggcttcgactggccgccgtcgccgtgacgcgtggcccgcgagagccgccgctgcgcttgcgttgcgcggaccgttttcggctcttgcttatataccgcgtgcgtgcctgagtcgttgtttgttgttcgtccccaagctttgcttgcagatgtaagctttcaatctttaagctctagcttgcagatatgtgaagtggactgctagtagtacactctagctgtaaactccggtgtttacctgaagcaaaccagcatgcaccggtgagatttcaccggcgccatccc

SEQ ID NO: 8634 - DNA, 818 bp, Zea mays
ggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgcaaaatggttgtgctcatttg

SEQ ID NO: 8635 - DNA, 1196 bp, Zea mays
tccgcggtccgcgcccgtgcaccatctcgcctcgcattcccgaaagtatctgtattccttgatcaacatgtcgcgggaggagaatgtttatatggccaagctggctgagcaagcagaacggtacgaggaaatggttgaatacatggagaaggtggctaagaccacagatgtgcaagagctcactgttgaggagcgtaaccttctatctgttgccttcaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgcaccttgtgccttcctccactgccacagagtcgaaggtgttttacctcaagatgaagggtgattatcacaggtaccttgctgagtttaagactggtgctgagaggaaggaatctgcagagagcacaatggtagcttataaggcagctcaggatattgcattggctgaactgccacctattcatcccataaggcttggacttgcacttaacttctcagttttctattacgagattcagaactctccagacaaagcttgcaatcttgccaaggaggcgtttgatgaagctatttctcagttggacatgcttggtgaggattcctacaaagatagcaacttgattatgcagctcctgagggacaacttgaccctctggacggaggacggcattgaggagggcttagaatcctcgaagggcgatgctggtgagggtcagtagcctggtaaacttagattgatggttcgacgtgtttctcaagcacatcgtgttggacgcccagtgctgacagaaggcttttgctgctccatgcattccaagcttctgccctttcgttcgcaccctcttcatgttgttggctggtagtggtcagatttagtcccattggtttagttggccctgggtccatctgaactgatgtattgttactgctatggaagtcattcctttagttttgctctggcagtggattgctgttgggtcgtgttttcagtctttattggttccgatcggacgctgttgcggcaaaccacccctgtagatactcttcacatgctgaagaaaactaccagcagccgtttagcctgaaaac

SEQ ID NO: 8636 - DNA, 2376 bp, Zea mays
ccctcccctaccctttccttccccactcgcacttcccaaccctggatccaaatcccaagctatcccagaaccgaaaccgaggcgcgcaagccattattagctggctagctaggcctgtagctccgaaatcatgaagcgcgagtaccaagacgccggcgggagtggcggcgacatgggctcctccaaggacaagatgatggcggcggcggcgggagcaggggaacaggaggaggaggacgtggatgagctgctggccgcgctcgggtacaaggtgcgttcgtcggatatggcggacgtcgcgcagaagctggagcagctcgagatggccatggggatgggcggcgtgggcggcgccggcgctaccgctgatgacgggttcgtgtcgcacctcgccacggacaccgtgcactacaatccctccgacctgtcgtcctgggtcgagagcatgctgtccgagctcaacgcgcccccagcgccgctcccgcccgcgacgccggccccaaggctcgcgtccacatcgtccaccgtcacaagtggcgccgccgccggtgctggctacttcgatctcccgcccgccgtggactcgtccagcagtacctacgctctgaagccgatcccctcgccggtggcggcgccgtcggccgacccgtccacggactcggcgcgggagcccaagcggatgaggactggcggcggcagcacgtcgtcctcctcttcctcgtcgtcatccatggatggcggtcgcactaggagctccgtggtcgaagctgcgccgccggcgacgcaagcatccgcggcggccaacgggcccgcggtgccagtggtggtggtggacacgcaggaggccgggatccggctcgtgcacgcgctgctggcgtgcgcggaggccgtgcagcaggagaacttctctgcggcggaggcgctggtcaagcagatccccatgctggcctcgtcgcagggcggtgccatgcgcaaggtcgccgcctacttcggcgaggcgcttgcccgccgcgtgtatcgcttccgcccgccaccggacagctccctcctcgacgccgccttcgccgacctcttacacgcgcacttctacgagtcctgcccctacctgaagttcgcccacttcaccgcgaaccaggccatcctcgaggcctccgccggctgccgccgcgtccacgtcgtcgacttcggcatcaaacaggggatgcagtggccggctcttctccaggccctcgccctccgccctggcggccccccgtcgttccggctcaccggcgtcgggccgccgcagcccgacgagaccgacgccttgcagcaggtgggctggaaacttgcccagttcgcgcacaccatccgcgtggacttccagtaccgtggcctcgtcgcggccacgctcgccgacctggagccgttcatgctgcaaccggagggcgatgacacggatgacgagcccgaggtgatcgccgtgaactccgtgttcgagctgcaccggcttcttgcgcagcccggtgccctcgagaaggtcctgggcacggtgcgcgcggtgcggccgaggatcgtgaccgtggtcgagcaggaggccaaccacaactccggcacgttcctcgaccgcttcaccgagtcgctgcactactactccaccatgttcgattctctggagggcgccggcgccggctccggccagtccaccgacgcctccccggccgcggccggcggcacggaccaggtcatgtcggaggtgtacctcggccggcagatctgcaacgtggtggcgtgcgagggcgcggagcgcacggagcgccacgagacgctgggccagtggcgcagccgcctcggcggctccgggttcgcgcccgtgcacctgggctccaatgcctacaagcaggcgagcacgctgctggcgctcttcgccggcggcgacgggtacagggtggaggagaaggacgggtgcctgaccctggggtggcatacgcgcccgctcatcgccacctcggcgtggcgcgtcgccgccgccgccgctccgtgatcagggaggggtggttggggcttctggacgccgatcaaggcacacgtacgtcccctggcatggcgcaccctccctcgagctcgccggcacgggtgaagctagacgtcattgagcgctgaatcgcagttagcgaccgggccaaggttctcgccggcgtgatgagatggaacactttgactcccgcggccggatcggcctgtgttcgttcttgtttccgatctcccttctctttcccgttgcttcgatcccgtcaagtatggtagaccgtagcctattgttatgtttaaatgtcaattattatgtgtaattcctccaagcgccgatatccaataaggacgaaccggattttcgtt

SEQ ID NO: 8637 - DNA, 1666 bp, Zea mays
cttgcttgaatatagtccccctcctctctctctcacacacctgttcttcgatctcggcctagctagctagctagcgagcaagctatagcttagctcggctagccgggtgtgtcgccggtcggctaggcaacgccgctagcgatcgcaaaatggcagatgcgggggaggggcggcgggtgtgcggcatgccggagaaggcgcagctgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgctctgcggcatcacggcgaaccaagggttttacctcctgggcctggacaacacgtcgccgacgttcgcgtccgccatccagaactcggtcccggccatcaccttcgccatggccgcggcgctgcggatcgagaaggtccggctggaccgccgcgacggcgtagccaaggtggcgggcacgctggcgtgcgtggcgggggcatccgtcatcacgctttacaagggccccaccatcttcggtcccagcgccagcggcggcctcgagctggcggcaaccagcaaggcggtggccggcgacaagaactggacgctgggttgcgtgtacctgatcgggcactgcctgtcgtggtccggctggctggtgctgcaggctcccgtgctgaagaagtacccggcgcggctgtccgtcacctcctacacctgcttcttcggcgtcatccagttcctcatcatcgccgccttcatggagagggacgccgacgcatggaagttccactccggatccgagctcttcaccatcctatatgccgggttcatcgcgtccggggtggcgttcgcggtgcagatctggtgcatcgaccgcgggggcccggtgttcgtggcggtgtaccagccggtgcagacgctggtggtggctatcatggcgtcgctcaccatgggcgagaagttctacctgggcggcatcatcggcgccgtgctcatcatcgccggcctgtacctcgtgctctggggcaagagcgaggagagggcgcgcttcgccagggacgccgccaccctcgtctccggcaccggcgaccgcgaggggctccttccggccggcggcggtggcatccggagcgccagcaaggcggcagcgtcggccgccacgcagcctctcttgctgccgtcctccacctccaccgacaatgtctgatcggtcgacctatgaatccttcgtcgtcatccatggaccatggtgcgtggagataagagactgcatgcgtacgatccatgaggcgctgccatgcatgctgcgcgctctggtgcacacatggattggagcagtatgatccgatccagcagtaataattatcatcagctagtctttttttgtggttttccttgttgatttcacgcatgtatgtatgctgcaacctacatatatgcattactatggtgtgtgtgtgtgtggtgagagcagacgacggcaaggtttattttaacttcgatcacgacctgcttgctgttcaagtatattaattctcgttgtac

SEQ ID NO: 8638 - DNA, 1908 bp, Zea mays
gtcagcgcagggcagggcagcctgaaagaaagcggcggcggcagcaggtcactggctcactgctctgtcctctcgtctccagagttcagaccaccgcatcgccatggcgccgccgcagacgatcccccggcgcggcctcttcattggcggggcctggagggagccgtgcctcgggcgccgcctgcccgtcgtcaacccggccaccgaggccaccatcggcgacatcccggcgggcacggcggaggacgtggagatcgcggtcgccgcggcgcgggacgcgttctcccgcgacggcgggaggcactggtcgcgcgcccctggggccgtgcgcgccaacttcctccgggcgatcgccgccaagattaaagacaggaaatctgagctggctttgctggagacacttgattctggaaagcctctggatgaagcaagtggagacatggacgatgtcgctgcatgctttgagtactatgctgatctggcagaagctttagatgggaagcaacagtcaccgatctctctgcctatggaaaactttaagtcgtatgtacttaaagaacccattggggttgttggactgatcactccttggaattatcctctgttgatggcaacttggaaggtcgcacctgccttggctgctgggtgtacaactatattaaaaccttcagagttggcttctgtgagctgcttagagcttggtgcaatatgtatggaaataggcctaccaccaggtgtcttgaacataattactggtctgggccctgaagctggtgctccattatcctcacattcccatgtggataaggttgcttttactggaagtacagagactggtaagaggataatgatttcagctgcccaaatggttaagcctgtttcattagagcttggtgggaaaagtcctcttattgtctttgatgacattggtgacattgacaaagctgttgaatggaccatgtttgggatcttcgcgaatgctggtcaagtctgcagtgctacttctcgtttactgctgcatgagaaaattgcaaagaaattcttggatagattggttgcatgggcaaagaatataaaagtctcagatccactggaggaaggctgcagactgggttcagttatcagtgaaggacagtacgagaagataaagaaattcatctcgactgcaagaagtgaaggtgccacaattctgtatggaggtggccgaccacagcatctcagaagagggttctttcttgaacctacaattataacagatgttagtacgtcaatgcaaatttggcaagaggaagtctttggaccagttatctgtgttaaggagtttaggacagagagtgaagctgtggaacttgcaaatgatactcactatggtttagctggtgccgtgatctccaatgatcaagagaggtgtgagcgcatttcaaaggctcttcactctggtattatttggataaattgctcgcaaccatgcttcgtccaagctccttggggagggaacaagcggagcggttttggtcgggagctcggagaatggggtcttgataactacctgacagttaagcaagtcaccaagtattgctcggatgaaccgtggggatggtaccagcctccatctaagctgtgaaggggcattcactccagggaatgtaatgcatcattaactgacagcatcagtcctgttaatggacaggagctcgtgtacagtacagtgctcgtaaaaaaagctctttgatggtaaagttgcttgctgctatcactactccagaccagaattcaggactggagagtacgatgtcatgagttgtactacttgttagtctgcactctttatcattcgaagtttggcagtggtgtgtagttgcacttggaagattgcaataataataaagataattggataattgatcc

SEQ ID NO: 8639 - DNA, 1885 bp, Zea mays
aagcaagcttcggcctcacctccagcggcaggtggtgctgcggagcttctcctcgccctagatcccgcgcacccaacgccagatcagagatcagggcgcgccggccgtctccattgccgggcggatcctgcgatgcgagctggaccgagagggaggagcgagggagcgcgcgggtagagaaggcggggcggggggaggaaggaaggaaggaaggagcgccggccggagcagacgtcccctcggggccctcggtcggatgagatcgacgatgaaggcgcagcacgccaacgggcgggggagcaggagccccttcctgacgtcctacgcgctcacgctcgccttcatcaccttcgtctccgtgctctactttaaggacttctcctccacgctgcaccgccccttcctccaccgcccccgccgccacgccgccccagacaaaagccaggcggggcgccgcgcggcggcggagcggctgccgttcgcggtgggcgcggcgccggcggggtgtgacgtcgggcgaggggagtgggtgtacgacgacgcggcgcggccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctactgggctccctttctggccgagtcgaattcggatgatgctgttgtgcaccggatcgcggatcggatcgtaagagggacatccattgagaagcatgccaagttttggaagggggctgacatcttggtattcaacacctacctatggtggatgactggacaaaagatgaagattttgcggaactccttcgaagataaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaaggtttgagttgcgaggtgcacggtgaagttggggtctctctctggcattggcacgctgcacaatactagttagcttggcattggcccagcagtctgaagatggatgctctgctgcggtatggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacacagtgcatgaatagttgtatggggtaatgtgataatacatactgtaattctctggttc

SEQ ID NO: 8640 - DNA, 966 bp, Triticum aestivum
gcagcaaaaccacacacacacgcagctagagctaatagagccggccgccttcattaacatatcgccacttgcgccggcggccggcggagaagggcgccagtggtgacaggaggaagaagatggtggggagcggcatgcatgcccagcgcggggacccgctggtggtggggcgcgtgatcggcgacgtggtggacccgttcgtgcggcgggtggcgctgcgggtcggctacgcgtccagggacgtggccaacggctgcgagctgaggccgtccgccatcgccgacccgccgcgcgtcgaggtcggcggcccggacatgcgcaccttctacacgctggtgatggtggatccggatgctccaagtcccagcgatcccagccttagggagtacttgcactggctggtcaccgacatcccggcgacgacaggagtgtcttttgggaccgaggtggtgtgctacgagggcccgcggccggtgctcgggatccaccggctggtgttcctgctcttccagcagctgggccgccagacggtgtacgccccggggtggcggcagaacttcagcacccgcgacttcgccgagctctacaacctcggcctgcccgtcgccgccgtctacttcaactgccagagggagaccggaaccggcgggagaaggatgtgatgatcaactccttgtataataccagtacttaagtagtataagtgacgacacaagatgatgatgatgatgaggtcgtatgggtggtggtttatacagggcgaaatggagaaagaattgtaatgttgaagaaataataactatgcgtgcgacttttttgatccgatgccggtgcgatactacaaagattaaaaagatgttaggatccaacgagccagttgggagatcgtacgggaatcagatgggaaccgtcgtatgtgtagcatcgttgttctaatatactacgtgaattgtctttatacttttt

SEQ ID NO: 8641 - DNA, 961 bp, Triticum aestivum
tagtgtatacacttgctctgagactccaaaatattatggcgaatgactccttgacaagggcacagatagttggagatgttctagacccatttgttagctcggtgcctctaactgtgatgtatgatgggaggcctgtgttcaatggcatggagtttcgctcaccagcagtctctctgaaacccagcgttgagataggcggtgatgatttccgtgtggcctatactctagttatggtggatcctgatgcgcctaatcccagcaacccaaccctgagggagtacctgcactggatggtgactgatgtcccatcatcaacaaacgatagctttggaaaagagatcgtgccatacgagagcccaagccctaccatgggcatccaccgcatggtgctggttctgtaccagcagctggggcgggggacggtgttcgcgccgcaggcacgccagagcttcaactcgcgcagcttcgcgcgccgcttcaacctcggcaagcccgtcgctgctgtgtacttcaactgccagcgtcccacgggcaccggtgggaggaggttcacctgatgtgtcaaactgatcgaccagcaatgatcctcagcccagccgacggcaatgcttgagctcaccggtacctgatactgtgataaagatatctagagaagttggaataaatgtactggaaggtttatgtctgatctatctagctggttgatcagccatggcccagctcgaaggcagtaagttaagctcgagctttgccggtacttatgtctgcgtgcttactaatacgtacacacatgatagccgcatcacacggtacttagctagacgagttggaataaagtacctgtgtttgtacttgtagactcttaagtaaagtgcctttgcaaggatgcgttgctacttatcaataaggaatgtgacattatgccacaccttggtaatgagatatgtgcggttggttgttc

SEQ ID NO: 8642 - DNA, 2376 bp, Agrobacterium tumefaciens
ctctaaagattctgccaataaaaccgacgggctgaagatgacgaatgccagtgaaatgccacgcaagctgaccatattgggttcgacgggttccatcggcaccaatactctggatgtcgtgcgtcaactgggtggccgcgacgggttcgagatcatggcgctgaccggcgcgggaaacatcgcgcttctggccgaacaggcgcgggaatttggcgcgcagctcgcggtcactgcggacgatgataaatatgaagcgctgaaatcggcgctggcaggcaccggcatcaaagtcgccgcaggcatggccggccttgaagaggcagcctcgatggatgccggctgggtgatggccgcgattgccggcacccccggcctcgccccgacactgacggccgcccggcgtggtgccgatattgcacttgccaacaaggaatgcctcgtttcggcgggcgatgtttttctgcgcactgtcaaacagggcggcggccggctgatcccggtcgacagcgaacacagcgcaatcttccagtgcctgacgggtgaatacaaacaggcggtggaacgcatcgtgctgacggcttccggcgggccgttccgcacctggtcgcgggacgagatgtccaacgtcacggcggatatcgcccgcgcccatcccaactggtcgatggggctgaaggtctcgatcggcagtgcctccatgttcaacaagggcctggaaatgatcgaggcgaaatatctcttcgatctcaggcctgatcaggtggacgtgattgtccatccacaatcgatcatccattcgatggttggctacactgacggctcctatatcgcgcagctcggctctcccgacatgcgcaccgccatctcctatgccctcacctatcctgagcgcggcaatctaagcgtcgagcgcctggatttcgcgaaactggcacggctcgatttcgaagcaccggacgaagcccgcttcccggcgctgcggcttgcgcgcatggcgctggagcgtggcggtttgcagggcgcggccctgaacgcagccgaggagaccgcctttcacgcctttgtcgctggtggcatcggttttctcgacatggccgaaattgttgaaacggtgatggaccgtatgcatgacggccgcaccgccgagacgatggacgacgttttttcggcagacgaagaggcccgccgccatgcactggaactcatcgccacaaaagaaaaggccgcgtgaacgcggccctgacctcttcaatctgaacggttgccttaagccaccgcacgcgccagtgcgcaatgcgaccagagctgatgcagcgcaccgacaagctgctcgatatcggcatcagtgtgcagcggtgtcggtgtaatacgcaggcgctctgtcttgcgcggcacggtcgggtaattgatcggctgcacatagacgccgtgattgtcgagcaggatatccgaaatccacttgcacttggcggcatcgccgaccatgaccggcacgatgtggcttggattgtccatatgcggaatgccgcgggcatcgagaagaccgcgcagcttgcggacccgatcctgatggcgcgcgcgctcaaaggggctagccttcagatgctggatcgacgcgatagcgccggcggcaagcgacggtggcagggccgtcgtgaagatgaagccggatgcgaaagaacggatgaaatcgcagactgcggtggagccggtgatataaccgcccatcacgccgaaggctttgccaagtgtaccctcgatgatcgtcagacgatccatcaggccttcgcgctcggcaatgccgccaccgcgcgggccgtacatgccgacggcatggacttcgtcgagataggtcatggcgccgtaacggtcggccagatcgcagatttccctgatcggcgcgatatcgccatccatcgaatagacggattcaaaggcaatcagcttcggcgcattgggatcggcagccttaagcttcgcttcgagatcttcgagatcgttgtgtttccagatcacccgctcgcaacgaccgtaacgaatgccctcgatcatcgatgcgtggttgagcgcgtcggagaagataatgaggcccggaattttctggccgagagtgccgagggttgcccagttcgaaacataacccgacgtgaaaatcagggctgattccttgccgtgcagatcggcgagttcctgctccagcaggacatgataatggttggtgccagaaatgttccgggtgcctcccgcacccgcgccacagtgatcgatggcggctttcatggcttcgatgactttcgggttctggcccatgccgagatagtcgttggagcaccagacggttacgtccttgcgatcgccattggcattgtactttag

SEQ ID NO: 8643 - DNA, 2123 bp, Agrobacterium tumefaciens
ctctaaaggtcgggccgggtggtgatcggcgaattcgaagggctcacctcccccgtttcggcctttaccgatacgctttatgtcgatctttcgctggagccgggggtaaaattccccttctctgccgatcatgaggagcgggcgatctatattctgtccggttcactggatgtggccggggatatcttcgcagccgatcagctgcttgtcttccggccgggcgacgacatcacgctgcaggccggcagcaatggctgtcacatcatgatttttggcggggcagcactcaatcagcgccgttacatctggtggaacttcgtttcgtcatcaaaagaacgcatagaacaggccaaacaggagtggagaaccggacgcttcgatatcgttcccggcgacgaagaagagtttgtccctttgccggaaggttgaaattctatagaagtatacgacatgcagggctcacccgccggctttcgtgatagagggcaccctgcggaccaccagaaaaggccgaacgattgaccggaatgccacagacaccattgctcgaccgggtgaattttccctccgatctcaaggagatcgatgatcgcgacctgccggaactggcacgggaactgcgcgacgagatgattgacgcggtgtcgaagaccggtggccatctgggtgccggcctcggtgtggtggaactgacgattgccattcacaaggtgttcaacacgccggaagaccggctgatcttcgatgtcggccaccaatgttatccgcacaaaatcctgaccggccggcgtgaccgcatccgcacgcttcgacaggaagacgggctttccggtttcacgcggcgggccgaaagcgaatatgacgattttggcgccggccattcctccacctccatttccgccggtctcggcatggcggtggcggcggggctcgatggcagcgaccgcaaggtcatcgccgtgatcggcgacggttcaatgtcggccggcatggcgttcgaagcgctcaacaatgccggtgcactcgatgcgcggctgatcgtcatcctcaacgataacgacatgtcgattgcgccgccgacgggtgcgatgagcgcctatctggcgcggctggcctccggccgcacctatatgggctttcgcgatttcggcaagaaactgaccgcctatctcggcaagaccatcgatcgcgccattacccgcgccgtgacccatgcccgcggttatgtgaccggcggcacgctgttcgaggagcttggtttctatcacatcggcccgatcgacggtcattccttcgatcaccttttgccggtgcttcgcaatgtgcgcgacaaccagaaaggccctgtcctgatccatgtggtgacgcagaagggcaagggttacgccccggcggaagcggcagcggacaaatatcacggcgtcaacaagttcgacgtcatcaccggcgcgcaggcgaaagccaagccaaatgcgccgagctataccagcgtgtttgccgaagcgctgatccaggaagcgaccctcgacgagaagatcatcggtgtcaccgctgccatgccgaatggtaccgggctggacaagatggccgagcttttcccgtcccgcaccttcgatgtcggcattgccgagcaacacgcagtcaccttcgcggcgggacttgcggccgatggttacaagccgttctgcgcgctttattccaccttcctgcaacgcggttacgaccagctggtgcatgatgtggcgatccagagcttgcccgtgcgtttccccatcgatcgcgccggcttcgtcggcgccgacggaccgacccatgccggctccttcgacacgacgttcctcgccaccctgcccggcatggtggtgatggcggcggccgacgaggcggagctaaaacatatggtccgcacggcggcggcttacgatgaaggcccgatttcattccgttatccgcgcggcgaaggtgtcggcgtcgaaatgccggcacgcggtgagattctccagatcggcaaaggccgcatcatcaaggaaggcaccaaggttgccctcctctccttcggaacgcggcttgcggaatgccttgcggccgccgaagatctcgatgccgcgggcctttcgctttag

SEQ ID NO: 8644 - DNA, 1044 bp, Oryza sativa
tatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgcctgcgagggccagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtccacctcctcgatgttgtttgtc

SEQ ID NO: 8645 - DNA, 1040 bp, Oryza sativa
cgcctccctcgcatcgcccctccccgaccccgccgagatcggagcaggcgccgcctccctcctcccgcctcctcctccgccatggcgccgtctctgctcggggggttcaccaagtcgctggccatgacggtgctctcggagatcggcgacaagaccttcttcgccgccgcgattctggccatgcgctatccccggaagcttgttcttgctggttgtctcacctcattaacagtgatgacggctctatcagtttcacttggttgggttgcgccaaatctgatatcacgcaaatggactcatcatgtgaccactctgctattctttgtgtttggcattttgtcattgtgggaaggcttcaaagaagatggagattcagaagaattggctgaagtggaagctgagctggatgctaattttaaaagcaacaaagcagaatcgaaaagtaaatctaaggcaaatgatgataaaaagaagcagcaaagaccatttgttttgcagttcttctcaccaatctttataaaggcattttccattacattctttggagagtggggtgataagagtcaaattgctactattggtttggctgctgatgaaaatccattcggtgttgtcctggggggagttctggcccaagcactctgcactaccgctgctgttatgggtgggaaaagcttggcctctcaaatatctgagaaaatggtcggattgtcgagtggagtgctattcctgctgtttggtatcatgtcatacttgtcaggaccagaaggagaattataatgcccccagaaagtcatgcataaggagaattatcatgttcatcatggccggttaacaagcttgttttcactacgacttgatctcatcttagtaggtggacgatggcgacgaaagcgctgatcctttgcaaggaggatggcgattacttagcttagtcaacacattgtaaacatttcactcatcattcataaataacaagatggtaccaaagactctactggttgcttcgtgttagtcccagcaccagacaacattcagcc

SEQ ID NO: 8646 - DNA, 797 bp, Oryza sativa
gcaaacgtgtcgcccattctacaccgtctccatccatctcatctcgtcgtcttcccccccgcgagtccgcgaccccccgcgctataaaatccaaggccgcgatcgagatgcggaaatatcgagtcgccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactacaacttacaagt

SEQ ID NO: 8647 - DNA, 947 bp, Oryza sativa
caaaaaacctcgcaaaaccctcggccctcacccgccgccgccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgcttt

SEQ ID NO: 8648 - DNA, 1437 bp, Oryza sativa
tttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcctttatttgtaagctcgatgtggacacgttggaattcgtgcttttcttattgtcatgagagttgagatgatgtttggattggcggcatcctgtccgtccaagggtc

SEQ ID NO: 8649 - DNA, 689 bp, Oryza sativa
gctcctcaaacgagaccaagaaatcaatcgttccagcgaagaagaagaagaagaaggaggaatccatggcggcgaggacggtggcggtggcggcggcgctcgccgtgctgctgattttcgccgcctcgtcggcgaccgtggccatggccggccggccaacgcctacgacgtctctcgacgaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaaaactgcaaatccgtcatgcatgcatggtatgcccatcgatccatccatgattatctctagttagatgtagtaacaaactgcatgcgcgtgttgtgctcatcagtgttaattttggccgcccccctgttgataaacagttcttgatcgatgagagctagctttcgttttgttttgatttgttggttggttggttgatttgagagttgagacagatcgatctctgcttgaatggtacctgtcccaatttcagactttcagattctaattacaacgcttctgattgatg

SEQ ID NO: 8650 - DNA, 1347 bp, Oryza sativa
gtcgctttctaattttttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagctcagcaagatctgtgatggtatccttaagcttctggattcccaccttgtcccatctgccactgctgcagagtccaaggtgttctacctgaaaatgaagggtgactaccacaggtaccttgctgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaccgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtcc

SEQ ID NO: 8651 - DNA, 964 bp, Oryza sativa
gaaaaacctcgcaaaaccctcggccctcacccgccgccgccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgctttaatctgcttttgtgagat

SEQ ID NO: 8652 - DNA, 854 bp, Oryza sativa
gaaaaaaaaccctaatccatccactccaaatcgccacgcaggaagggaggaaaggaccaccagccaccgcgcgcgcccaaatcgtcgcagctgcttccccgaggagaagaacatgagtcgccacccgagcactaagtgggcgcagaggtccgacaaggtgttcttgacgatcgagctgcccgatgccagggatgtgaagctcaacctgaagcctgagggccagttcatcttctcggcgaagggccctgccgacgacaccccttatgagcttgatcttgagctctttgatgctgtgaatgttgaggagagcaaggcagctgttgcggcaaggtccatatgctatcttatcaagaaagcagagagcaagtggtggcctaggctgctgaagaaggaaggcaagccacctgtgttcctcaaggttgattgggataagtggcaagatgaggatgatgaagacattgggcttggtgacttcggtgatatggacttctcgaagctgggcatgggaggtcctgatgatgatcttgaggacgatgacgaagatgacacggctgacagtgctaacaaagatgatgaagacattaaggcagaggggagcggggaacaggaagctgctggtgaagcgaagccgtgaaatacctgagagttttagaacgctatgcttgacttgtttgtgacgctgccaggtcttaagatttttttggtgtaaactctggagagtggatcactgccactaaagtaaagtagtagttatggtttagtagctccattttgttaaaaaactttgtgcattgcacactgttctgttatgtgaatcgccatatttgcatcaaccattgcaaagctatccagcc

SEQ ID NO: 8653 - DNA, 857 bp, Oryza sativa
gtctccgtctcgtgtcccacgcacgcacacctttccccccctctctccctccctcctccgccatccctagcagccgccccgcacccgcgcccgcaccatgacgagctcctcctccccttcccgcaaggtgctgagcaagatcgcgtgcaaccggctgcagaaggagctcgcggagtggcaggtcaaccctccctccggcttcaagcacaaggtcaccgacaatctccagaggtgggtcatcgaggtcgcgggggctgcgggcacgctctatgccggagagacataccaattgcaggtggacttccctgagcattaccccatggaggctccccaggtcatatttcttcatccagcgccaatgcatccgcacatttacagcaatgggcatatctgtttagatatattgtatgactcgtggtcaccggcgatgaccgttagttctgtttgtatcagtatcttgtccatgttgtcaagctcaccagcaaagcaacgtcctgccgacaatgatcgctatgtcaggaactgccgcaatgggaggtcgccgaaggagaccaggtggtggtttcatgatgacaaagtgtgattggttccaacttccggttggcttctcctcagcaacccttttacccgccaccctacctttacatggcgtcctccatgggagatgatttaggcatatttttaagcgatctatttgaccgcaaattaacatgcctttgtggtttgtaaatgaatgtgaacctgtatcgaatcctagacttattaattactataccttggatatatagaataattacatgtgtatcttgcttattgcccaaaatagaggcatcaaatgcagtcaaaactttggtttt

SEQ ID NO: 8654 - DNA, 659 bp, Oryza sativa
cggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtactaagtaagaatgattgcaaggtgtattaactacaaatattgcaataaaagtccctgttactac

SEQ ID NO: 8655 - DNA, 1132 bp, Oryza sativa
gccagagcgcgaggagacgcacacagagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtc

SEQ ID NO: 8656 - DNA, 1182 bp, Oryza sativa
ggcaacatcgttgagattctggaaatgaaccctgaggatgaagctgaggaggatggtgctaatattgatttagactcacaaaggaaaggaaaatgtgttgttctgaagacttccacaagacaaactatattccttcctgtggttgggctagttgaccctgataaactcaagcctggtgatttggttggagtaaacaaagacagctaccttatactggacacactgccatcagagtatgattcacgagtaaaggcaatggaggtggatgaaaaacccacagaggactacaatgatattggaggtcttgaaaagcagattcaagagcttgtggaggcaattgttttgccaatgacacacaaagatcggttccaaaagttgggcattcgcccccccaaaggagttcttttgtatggaccacctggaactgggaagacattgatggctcgtgcatgtgctgcacagacaaatgcgacgttcctgaaattagctggtccacaattagtccagatgtttatcggtgatggagcaaagctggttcgggatgcttttcagcttgctaaggagaaagctccctgcatcattttcattgatgagattgatgccattgggactaagaggtttgacagtgaggttagtggtgacagagaagttcagaggactatgttggaattgctgaaccaactcgatggatttagtagtgacgagcggataaaggtcatagcggcaacgaatcgtgctgacattcttgatcctgctttgatgcgatctggtcgtttggaccgaaagattgagtttcctcatccatctgaagaagcaagagctagaatcttgcaaattcactcaagaaaaatgaatgtaaacccagatgtgaattttgaagagctggctcgctcaacagatgacttcaatggagcgcaactgaaagctgtttgtgtcgaagctggtatgcttgcactgcggcgagatgctacagaggtgactcatgaggacttcaacgaaggcataatacaggtgcaggctaagaagaagtctagcctaaattattacgcttaacaagctatgctagaatcatcagggctctggagttgtttgtaaccatactgtttggataatcgaaaatatggcttcacgtttcatttgaggtataacttttttacactataaagtcatcacttgcttctt

SEQ ID NO: 8657 - DNA, 1055 bp, Oryza sativa
cgacgacttgggaattcatttgcatcggcaacgacgatgaagctcgccgtggtcgccgtcgcggcgctcctcctcgccgccggcgtcgcctccgccgatgaattcgacttcttctacctcgtccagcagtggcctggctcgttctgcgacacgcaggctgggtgctgcttcccggacaccggcaagccggcggcggagttcggcatccacggcctgtggcccaactacgccaagtgccgtcccgccgccggcgccgtcgccgacgacgacgacggcgtggtggagatggtggtcgacggcggcgccgccgtcgagcgccaccaccggcggcggcagaagtgctggccggagtactgcgacgacggcaacaagctgcggccgtgggagatcaaggacctcgtggcggagctcgatgcgaactggccgacgctgtcgtgcaagggcggcaagagcttcgagttctggagctacgagtggaagaagcacggcacctgctcgggcatgggccagcacggctacttcgcggcggcgctggagctcaagaagcggcacgacctcgccgccgtcctcgccggcgccggcatcgtcccctccgacgacgagagctactccctcggcagcatccgcgacgccatcgccgccgccacgggcgcggtgcccaacctcgagtgcaaccgcgacgccgccggcgagacgcagctgttccaggtgtaccagtgcgtcgaccgctccgggaagaagctcgtcgactgccaactcccgatgcagggcaagtgccgcgacaaggtcaagctgcccacgttctagctagctagctcccccgtcgccatcgtcgccggcgagagctcgccgtcgccggcatggcggcgcgccggcggctggctggtcttggatgtctgatggatgtcacgtgcgtttgcgttgttgcgtggtgcggttttcagattacgagagattcgaggatttgtccagttggattgctacatgtgtacgttacatttggcactatctgctgacttgctgaacagttgaataataacatatcaagttttacc

SEQ ID NO: 8658 - DNA, 1170 bp, Oryza sativa
gccgccgcagccgcagccgccgccgccgacgccgacgaggagaggaggagagggaaggcgagagggaggtaggtaggtaggcagttagccatgtcgccggcggagccgacgagggaggagagcgtgtacaaggcgaagctggcggagcaggcggagcggtacgaggagatggtggagtacatggagcgcgtggcgcgcgcggcggggggcgcctccggcggggaggagctcacggtggaggagcggaacctgctgtccgtggcgtacaagaacgtcatcggcgcccgccgcgcgtcgtggcggatcatctcgtcgatcgagcagaaggaggagggccgcgggaacgacgcccacgccgccaccatccgctcctacaggggcaagatcgaggccgagctcgcccgcatctgcgacggcatcctggccctgctcgactcccacctcgtcccctccgccggcgccgccgagtccaaggtcttctacctcaagatgaagggcgactaccacaggtaccttgcggagtttaagtctggcgacgagaggaagcaggctgcggagagcaccatgaatgcatacaaggctgctcaggacattgctctcgcagatttggctccgacccaccccataaggcttgggcttgcactcaacttttcagtgttctactatgagatcttgaactcccctgaccgtgcctgcaacctcgcgaagcaggcgtttgatgaggccatatcagaactggacagccttggtgaagaatcctacaaggacagcactttgatcatgcagctcctgcgtgacaacttgactctgtggacttcagatgccaatgatgatggtggtgacgaaatcaaggaagccgcagctccaaaagagcctggggatcagtgagatgaattcggacgccagtctgatgcaccatctgttgttgttggggcaatggacattgatgtcttcggctttcagtagctatcttctagtacacgaactgtcgtcgcaccatcgcggaggagacgatgatgttcttaaattacttaagtagttctgggtcacgcttttgttcagttgataaatgatggctggatcctggttttcttgttccacgatgccagccacaggaaaaaccctactattctgcactgttagaatgctgttatattaaccatgtttgac

SEQ ID NO: 8659 - DNA, 1070 bp, Oryza sativa
gccaagacgacgacgacttgggaattcatttgcatcggcaacgacgatgaagctcgccgtggtcgccgtcgcggcgctcctcctcgccgccggcgtcgcctccgccgatgaattcgacttcttctacctcgtccagcagtggcctggctcgttctgcgacacgcaggctgggtgctgcttcccggacaccggcaagccggcggcggagttcggcatccacggcctgtggcccaactacgccaagtgccgtcccgccgccggcgccgtcgccgacgacgacgacggcgtggtggagatggtggtcgacggcggcgccgccgtcgagcgccaccaccggcggcggcagaagtgctggccggagtactgcgacgacggcaacaagctgcggccgtgggagatcaaggacctcgtggcggagctcgatgcgaactggccgacgctgtcgtgcaagggcggcaagagcttcgagttctggagctacgagtggaagaagcacggcacctgctcgggcatgggccagcacggctacttcgcggcggcgctggagctcaagaagcggcacgacctcgccgccgtcctcgccggcgccggcatcgtcccctccgacgacgagagctactccctcggcagcatccgcgacgccatcgccgccgccacgggcgcggtgcccaacctcgagtgcaaccgcgacgccgccggcgagacgcagctgttccaggtgtaccagtgcgtcgaccgctccgggaagaagctcgtcgactgccaactcccgatgcagggcaagtgccgcgacaaggtcaagctgcccacgttctagctagctagctcccccgtcgccatcgtcgccggcgagagctcgccgtcgccggcatggcggcgcgccggcggctggctggtcttggatgtctgatggatgtcacgtgcgtttgcgttgttgcgtggtgcggttttcagattacgagagattcgaggatttgtccagttggattgctacatgtgtacgttacatttggcactatctgctgacttgctgaacagttgaataataacatatcaagttttaccagttg

SEQ ID NO: 8660 - DNA, 1307 bp, Oryza sativa
gcggggtgcccggcccggcgctggcggagtactacgcgcagcggaccacccagggtggcctgctcatctccgagggcaccgtcgtctcgcccgctggcccggggtttcctcatgtccctgggatatacaatcaagagcagactgatgcatggaagaaggtggtggatgctgttcatgccaagggaggcatctttttctgccagttatggcatgtaggcagagcttctcaccaagtataccagccaaacggtgctgcaccaatatcctcaactgataagccaatatcagcaagatggagaatactgatgcctgatggctcctatggcaagtatcctaaacctaggcgcctggcagcatcggaaatacctgaaattgtcgaacaatatcgtcaagccgccattaatgccattgaagcaggttttgatggcattgagatccatggtgctcatggctatatcattgatcaattcctaaaggatggaatcaatgaccgcactgacgagtatggtggctcactttccaaccgctgccggttcctacttgaggtaactagggctgtggtttctgccattggagcagaccgagtcgcggtgaggatatcaccagccattgatcaccttgacgcctatgattcagaccccattaagctcggcatggccgttgttgagcggctgaatgctctccagcagcagtcagggcggctcgcctacctccacgtcacgcagccacggtacaccgcctacgggcagaccgagtctgggcagcatggcagtgccgaggaggagagccgcctgatgcgcaccctccggggcacgtaccagggcacattcatgtgcagtggcggctacacgcgggagcttgggttggaagcagtggagagcggcgatgccgacctggtgtcgtacgggcggctcttcatatcaaacccggacctggtcgagcggttcaggctgaacgccgggctgaacaagtacgtgcgtaagacattctacacgcccgatcctgtcgtgggttacacggactatccgttcctcggacagcctaagtcgcggatgtaaatgtactgcgggataagtaaatcaaggatacgattgtgtattgtaaggaaaataaagggcaacggtgaggtgatttagcttatttttgggacctaatttgacggtaatttattctttcaccaaatctgatatgatccattgctgattcagtagctactctagcctatgtaaaccttgggtcatcagcacagattgtatctatatgtgtattgcataatgtttcatatcagttgtctagcagatttatgc

SEQ ID NO: 8661 - DNA, 2391 bp, Oryza sativa
ccaaaccctagccgcctctcgtttcttctcgtcctctccacgcccccgagatctcaggagcacaggaggaggaagccatggcgtcggagaccgagacgttcgccttccaggccgagatcaaccagctgctgtccctcatcatcaacaccttctactccaacaaggagatcttcctccgcgagctcatctccaactcctccgatgcattggataagattaggttcgagagcctcacggacaagagcaagctcgatgcgcagccggagctgttcatccacattgtccccgacaaggctagcaacaccctgtcgatcatcgacagtggtgtcggcatgaccaagtcggacctcgtcaacaacctcggtaccatcgccaggtcggggaccaaggagttcatggaggcgctcgctgctggtgctgatgtgtccatgattgggcagtttggtgtcgggttctactccgcctaccttgttgctgagagggttgttgtgaccaccaagcacaacgacgacgagcagtatgtgtgggagtcacaggccggtgggtccttcactgttacacgtgatacctctggtgagcagcttggacggggtactaagatcaccctctacctcaaggatgatcagctggaataccttgaggagcgtcgcctcaaggatctggtgaagaagcattctgagttcatcagctaccctatctccctatggactgagaagacaactgagaaggagatttctgatgatgaagacgaggaagagaagaaggatgctgaggagggaaaggttgaggatgttgatgaggagaaggaagagaaagagaagaaaaagaagaagatcaaggaagtctctcacgagtggaacgtgatgaacaagcagaaacccatttggttgaggaagccagaggagatcaccaaggaagagtacgctgctttctacaagagcttgacaaacgactgggaggaacatctggctgtcaagcacttctctgtggagggtcagcttgaattcaaggccatcctgtttgtaccaaagagagcgccatttgacctctttgacaccaggaagaagcaaaacaacatcaagctgtacgtacgccgggtgtttatcatggacaactgtgaggagttgatcccagagtggctcagctttgtcaagggcattgttgattctgaagaccttcccctcaacatctcacgtgagatgctccagcagaacaagatcctgaaggtgatccgcaagaaccttgtgaagaagtgcgtggagctcttctttgagatcgctgagaacaaggaagactacaacaagttctacgaggctttctccaagaatctcaagcttggcatccatgaggattccaccaacaggaccaagattgctgagctcctgaggtatcactccaccaagagtggtgatgagttgaccagcctcaaggactacgtaacccggatgaaggagggccagagtgagatctattacatcactggtgagagcaagaaggctgttgagaactcccccttcctcgagaagctgaagaagaagggttatgaggtcctgtacatggttgatgccattgatgagtacgctgttggtcagcttaaggagtttgaaggcaagaagctcgtctctgccaccaaggaaggtctgaagcttgatgagagtgaggacgagaagaagcggcaggaggaactcaaggagaagttcgagggtctgtgcaaggtgatcaaggaggtgctcggtgacaaggtggagaaggttgttgtctctgaccgtgtggtggactctccctgctgtctagtcactggggagtatggctggactgctaacatggagaggatcatgaaggcccaggctctgagggactccagcatggccggctacatgtctagcaagaagaccatggagatcaacccggagaatgccatcatggacgagctccgcaagcgtgccgatgcggacaagaatgacaagtccgtgaaggacctggtgatgctgctcttcgagactgccctgctgacctccggtttcagcttggaggaccccaacaccttcggcaccaggatccaccgcatgctcaagctcggcctgagcatcgacgaggacgagtccgccgaggctgacgccgacatgccgccgctggaggacgacgccggcgagagcaagatggaggaggtcgactaaacgtcatggacccatggatgccattctgtcccttctagttatccctctcctagttctcttctcatagctatctgactgctgctgttcgctttctttttggtacgttggatgcatcagttttgtctttgtcttagctcttaaacaatgcgtggtaccttgtcatactgtttgcgttgcaatgctactagccgaagtatatgccagcttcttattc

SEQ ID NO: 8662 - DNA, 1598 bp, Oryza sativa
caacgagtcaaatttgaaggcttcactgagcctttgacaatggcgccgcagctgccgctcgaggtggcctctgctcccaagctcgacgacgacggccacccacaacgcaccgggaatctatggacgtgcgtagcgcacattatcaccgcggtgatcgggtgcggcgtgctggcgctgtcgtggagcgtcgcgcagctcggctgggtggccggccccatcgccatggtgtgcttcgccttcgtcacctacatctcggccttcctgctgtcgcactgctacaggtctcctggctcggagaagatgcagaggaactactcctacatggacgccgtcagagttcacttagggaggaagcacacttggttatgtgggttgctgcagtacctgaacttgtacgggataggaattgcttacacaatcactacggcaacttgtatgagggcaattaagagggcgaactgctaccacagcgaaggccgtgacgctccctgcgactcgaacggtgaacacttctacatgctgctcttcggagcagcccagctgctgctgtccttcatacccaatttccacaagatggcgtggctgtccgtcgtcgcggcgatcatgtccttcgcctactccaccatcggcctcggcctcggcctcgccaagaccattggtgatggaactgtcaaagggaacattgccggtgttgcgatggccaccccaatgcagaaagtttggcgagtggctcaagcaattggcgacatcgcattcgcctacccgtacaccatcgttctcctggagatacaggacacgctgagatcgccaccgccggagagcgagacgatgcagaagggcaacgtgatcgcggtcctcgccaccaccttcttctacctctgcgtcggctgcttcggctactccgccttcggcaacgccgcgccgggcaacctcctcaccggcttcggcttctacgagccctactggctcatagacttcgccaatgcctgcatcgtgctccacctcctcggcggctaccagatgtttagccagcagatattcacgttcgccgaccggtgcttcgcggcgagcttcccgaacagcgcgttcgtgaacaggtcgtactccgtcaagatcctcccgtggcggcgcggcggcggcggcggcggcgcggggaggtacgaggtgaacctgcagcgggtgtgcttcaggacggtgtacgtggcgagcacgacggggctggcgctggtgttcccctacttcaacgaggtgctgggcgtgctcggcgcgctcgtgttctggccgctcgccatctacctccccgtcgagatgtactgcgtgcagcggcggatctcgccgtggacgccgcggtgggccgcgctgcaggcgttcagcgtcgtctgcttcgtcgtcggcacgttcgcgttcgtcggctcggtggaaggcgtcatcagaaagaggcttggctagctagctagctagtagcgagtaatttagcctggtcatcgagaacgaaatgtaaagctagctcagtgtgccatttcatctgaagtaaaaaggcgcggtgaactgtacaatacatatgcagaaaaaatgataaacataagatgttggttatt

SEQ ID NO: 8663 - DNA, 1580 bp, Oryza sativa
gcgagcaagcaagagcggttttagccatcaaagccgaaagccatccgggcattcgctctcccctcgctgctagctagctttgcttgctaatctagagctaagcaccaaatggtcctgattgttcttctcgcttctgaattgttgtgacctgtaactacaaaggcatagttaggtagatatagaaagagggggggagaggggccggaggccggagcggcgggggcggcggcgagatgaagctccacttcgtgctcaggttcctgttcggccccgtgccggtgtacttctcggcgctggccatcctcatcctgctgacgaacgcgcagtacttcgggctggtgggcgtcaccgttccccgcgcgacgaagctggcgtcgtcggcgccggtggtgagcgtgatgaagtactgcgacatcttccgcggcgagtgggtgccggactccgacgcgccctactacaaccacaagacgtgttacatgatccaggagcaccagaactgcctcaagtacggccgccccgacctcgaattcctcaagtggcggtggcgcccctccggctgcgagctgccccgcttcgaccccgtgcagttcctacagttcaaccgtcacaagtcgctcgccttcgtcggtgactcgctggctcgcaaccacatgcaatccctgctctgcctcctctcccaggtggcgtatcccaaagacatgtcggcgaacccgacgactcagaacaaggtgtaccactacagggggtacaacttcaccgtcagcatgttctggtcgccgttcctggtgaaggcgcgtgagcccgaccacgacgggccggcgcacacgggccactggagcctgtacctcgacgagcccgaccagtcgtgggtgtccgagatctcgcggttcgactacgtgctggtgtccgccgccaactggttctccaggccgtcgctcttctacgagaagcggcggctggtcgggtgcagcttctgcagcaggcagtacggcgtgccggacctgacgctctactactcgcagcgccgggcgtggcgcgtggcgctgaaggcgatcaacgacctggagagcctccgcgggcgggtgatcgtgcggatgctgtcgccgatgtcgcacttcgagaacgggacgtgggaccagggcggcaactgcaagcggacgcagccgctccggagcaacgagacggtgatggaggggcgggacctgcacttctacacggcgcagatggaggagtaccgcgccgcggagaaggtcgcggaggccaagggccggcggatgatgctcatggacgccacggcggcgatgctgatgcggcccgacggccaccccagccggtacggccacctgccgaaccagaaggtgcagctctacaacgactgcatccactggtgcctgccaggccccatcgacatctggaacgacatgctcttccagatgctcctcgtctaacgcgatcgatcgccaattcgccatcggtaaatgcgacttctactgcacagacaggattgctcttgctgttgtttcaaagcagttttgacaaggatttattcgaacttccccaatagattctttttttctctc

SEQ ID NO: 8664 - DNA, 1292 bp, Sorghum bicolor
agccgccactcccacgaccacgaacgccggcgaccgagcggaaacgaaccagttatctagtggagctgcctcgtccaaggtactgtaatgtcctttctattcaagtctagcaatggtggtaccactgaaaaaaccatgcccctggaagaacagcaagaaaaaataaatgaactacgcaaggtgcttggtgaccactcatcaccagccattcaagacttcctttcagatgcctcattagcgagatttcttcgagcaaggaactggaatgtgcagaaagctagtaaaatgatgaaagcagctgtgaagtggcggcttgcattcaaacctgaaaacatctgttgggatgatatttcagaggaagcagagaccggaaagatatatagggcagactataaggacaaacatggcagaactgttcttgtattgaggcctggtttagagaacactacctcagcaacaggacagatcaaatatctagtctactctctggagaaagcaattatgaacctgacggaagatcaagagaagatggtatggctgacagatttccagtcctggacattgggaagcacaccactgaaggtgacccgtgagactgtcaatgtcttgcaagactgttatcctgagaggttggggcttgcaatcctttacaaccctcctaggatatttgaatcattctggaagatagtgaagccgttcctggaccaagagacccgcaagaaggtgaagtttgtgtactccaacgacaaggagagccagaagataatggcagaagtctttgacatggaggagctcgactcggcatttgggggaaagaacccagcgacatttgagtacaacagctacgcagagcgaatgcaggaggacgacaagaagatgggatcgttgcacagttcaaccaatagcttgcttgaatcagctgagaaggaggctaatggcgcagactcggacgcctcaagtgaggcctccttctacagtggaactgactctccgaaacatgaggacggtgaacacagcatcgcaaagaagagcggctgagctaaactgctttgattgctcaaattgagggagctgaggaatggaataggtcaacatatctagcttgaacgattgtcaggaccgatggcgatgagccgatgacagattacaagctggttagataacgttgccgggtctaggcggaatgtatatttgctgctcatgatattagagtatatgtaagagtttggaccatcaacgctgaattggtgatgcgttatacatctttggaataagtttaacttctccgcggt

SEQ ID NO: 8665 - DNA, 1448 bp, Sorghum bicolor
aaacccccaaatccgctcccttcccctatccacctcgactcccttccttccatagcagcggcagcggcggcggcggcgaagggcggcggagccatgggcggagccggcggcggcggcgaggcgaagcggtcggagatctacacctacgaggccgcctggcacatctacgcgatgaactggagcgtgcgccgcgataagaagtaccggctcgccatcgccagccttctcgagcaggtcaccaaccgcgtcgaggtcgtccagctcgacgaggcctcgggcgacatcgcccccgtcctcaccttcgaccaccagtacccgcccaccaagaccatgttcatgccggacccgcacgcgctccgccccgacctgctcgccacctccgccgaccacctgcgcatctggcgcatcccgtcccccgacgacgccgacgacggcgccgcctctgccaacaacaacaacggctccgtccgctgcaacggcaccccgcagccgggcatcgagctgcgctgcgagctcaacggtaaccgcaacagcgactactgcggcccgctcacctccttcgactggaacgacgccgacccgcgccgcatcggtacctcctccatcgacaccacctgcaccatctgggacgtcgagcgcgaggccgtcgacacccagctcatcgcccacgacaaggaggtctacgacatcgcctggggcggcgcgggggtctttgcctccgtctccgccgacggctctgtccgcgtctttgacctacgggacaaggagcactccacaatcatttatgagtctggttcaggtggcggcggcggcggttccaactcgggcgccggggatggtgggactgcgtccccgacaccactcgtgaggttgggctggaacaagcaggacccaaggtacatggccaccatcatcatggacagccccaaggtggttgtgcttgatatccgctacccaacactgccagtggtagagctacatcgtcaccatgcccctgtcaatgccatagcgtgggcgcctcactcttcttgccacatctgcacagctggggatgacatgcaggcactgatatgggatttgtcatctatgggaactggtagcaatggtagtggcaatgggaatggtaacgcagctgcggcagcagcagctgagggcggtcttgatcccattttggcatatacagcaggggcagagattgagcagttgcagtggtcggcaacccagcctgactgggttgcaattgcatttgccaataagcttcagattctcagggtctgatttcctaattctgccctgtttcactgaggagtaaaaagaatgccaaacttggataatgaggttaggccatgggaggataatcttttgtgcttgctttagttgcttatttatgttgtggacaactgatattcgtggtgggtcatttctagttatagaacagaagacttgct

SEQ ID NO: 8666 - DNA, 1085 bp, Sorghum bicolor
ccgctcccgtgcaccgccgcgactcgcacccccggaagtaactctattccttgatcaacatgtcgcgggaggagaatgtctacatggccaagctggctgagcaagcagaacggtatgaggaaatggttgagtacatggagaaggtggctaagaccgttgatgtggaagagctcaccgttgaggagcgtaacctcctatctgttgcctacaagaatgtgattggggcccgccgtgcctcatggcggattgtctcctccatcgagcagaaggaggagtcccgcaagaacgaggaacatgttgctcagattaaggagtaccgtggcaagattgaggctgaattgagcaacatttgtgatggtatcctgaagctgcttgactcgcaccttgtgccttcctccactgctgcagagtcgaaggtgttttacctcaagatgaagggtgattatcacaggtaccttgctgagtttaagactggtgctgagaggaaggaatctgcagagagcacaatggtagcttataaggcagcccaggatattgcattggctgaactggcacctactcatcccataaggcttggacttgcacttaacttctcggtgttctattatgagattctgaactctccggacaaagcttgcaaccttgcaaagcaggcatttgatgaggctatttctgagttggacacgcttggtgaggaatcttacaaagatagcaccttgattatgcagctcctaagggacaacttgaccctctggacctctgacatcacggaggagggcactgaggagggcaaagaagcctcgaagggtgatgctgagtagcctggtaaaccttgatggatggttcggcatgtttttctagcccatcttgttggacgccctgtgctgatagaaggtgtttgctgctccatgcattccaagattctgtcttctcgttccctccctgctgtagctggtggtagtagtcaaattagccccattgctttagttggctctgggtccatttggactgatgtattgttactgctgttgaagtcattcgttctcgttttgctcttgcagtagattgctgttgggttgtgcttt

SEQ ID NO: 8667 - DNA, 1272 bp, Sorghum bicolor
gtcgacccacgcgtccgcgaacggcgagcagcaggagggcgtcgcgaacccttgggcggcggatcggtacccgtaggcagccactactactaccgcgccccttcgcacgtcccgcgccgctcccgcccccgcggacgcggcggcgtcgtcagcctgcgtccgatggcctcgtcgacggcggctcagccccccgcgccggcgcccccgggcctgaaggagggcatcgcggggctgtacgacgagtcttcggggctgtgggagaacatctggggcgaccacatgcaccacggcttctacgactcgggcgaggccgcgtccatggccgaccaccgacgcgcccagatccgcatgatcgaggaggcgctcgccttcgccgccgtcccatccccagatgatccggagaaggcaccaaaaaccatagtagatgttggatgtggcattggtggtagctcaaggtacttggctaagaaatacggagcacagtgcaaggggatcacattgagccctgttcaagctgaaagaggaaatgctcttgctacagcgcaggggttgtcggatcaggttactctgcaagttgctgatgctctggagcaaccgtttcctgatgggcagtttgatctggtatggtccatggagagtggcgagcacatgccggacaagagaaagtttgttagtgagctggcacgcgtcgctgctcctggagggacaataatcatcgtgacatggtgccataggaacctcgaaccatctgagacttcgctaaaacccgatgaactgagtctcttgaagaggatttgcgatgcgtactacctcccagactggtgctcaccttcagactatgtgaacatcgccaaatcactgtctctggaggatatcaaggcagctgattggtcagagaatgtggccccattttggcccgctgtgataaaatcagcactaacatggaagggcctcacctctctactgacaagcggatggaagacgatcagaggggcgatggtgatgccgctgatgatccaaggttacaagaaggggctcatcaaattcaccatcatcacctgtcgcaagcctggagcagcgtaggtgaccaaggggcagaagttactgtcaaagcacctctgctaagtccaataatgtagatccatggccccatcaccgtctattgtactgtactgtactgtaccagaatgaacagtctcctgggacatgttttccaattgccatgacatgtcaaatgatcttctaccaaaaaaaaaaaaaaagggcggccgc

SEQ ID NO: 8668 - DNA, 943 bp, Sorghum bicolor
cgcaaacctctctccctcgtctggtatcgtctctcccacacccaaaaaaaaccctcgaaaagcggcggcggcgcgacatggcggaggtcgaggttccagctgctgcggtcgcgacgacgatccctgaggcggcggaggctaccgagggcggagccgctgcggaggcgaagggtccgcacaagctgcacaggcagtggaccttctggtacgacatccagtcgaagcccaagcccggcgctgcgtggggcacctccctcaaaaaggcctacaccttcgacaccgtcgaggagttttggagcttgtatgatcagatttttcgtccaagcaagttgtctgggaatgctgattttcatctgttcaaggctggagtagagccaaaatgggaagacccagagtgtgcaaatggtggcaaatggactgtcccatgcaacagaaaggcaacctttgagaacatgtggcttgaaacgttgatggctcttattggggagcagtttgatgaaacagaggacatttgtggaattgttgctagtgtccgtgcaagaggagataagctcgcattatggactaggactgccagcaacgaagctgtccaggtgaacattggcaagaaatggaaggatgtcatcgactacaatgacaagatcacctacactttccatgacgactccagaagagagaagccgagcaggggcggacggtacaccgtgtaagctgcacatcaacaaggttgcttggactggatagcgggcggagtggaattttctgctgagatcagcaccaactttcatttgataagccttggcttacctgaggcaattttcgcacctattgtgatgttattttgctttcagatagcttatgtagtacaagaaagagaggttggagacattgacgattttgtatgcaactgaatttctatctgaatctgccccgattcaactgc

SEQ ID NO: 8669 - DNA, 1820 bp, Sorghum bicolor
ttgttttcttccccttctggcttctggccttctccttctacacagtctagaggcgtctgctcccccaatcccttccgcccgccccgcctgctcgacgcgatcccgccggcggccatggatccgtacaagcaccgcccttctagcgggagcaactccagcttctggaccaccaactccggcgcccccgtctggaacaacaactccgcccttaccgtcggacagcgaggacccatcctccttgaggattatcatctaatcgaaaagcttgctcagttcgacagggaacgtatccctgaacgtgttgtgcatgcacggggagccagtgccaagggtttctttgaggtcactcatgatatctctcaccttacatgtgctgattttctccgggctcctggggtccagacacctgttattgtccggttctctacagttgtgcatgagcgtggaagccccgagaccttgagggatccacgtggttttgctgtcaagttctacaccagagagggtaactttgaccttgtgggtaacaacatgcctgtgtttttcatacgagatgggatgaaattccctgatatggtccatgctttcaagccaaacccaaagaccaatttgcaggagaactggagaatagtagatttcttctctcaccacccagagagcctgcacatgttcaccttcctctttgatgatgttggcatcccactcaactacaggcacatggagggctttggtgtcaatacctacaccttgatcaacagggatggaaagcctcaccttgtgaaattccattggaagcctacttgtggcgtgaaatgcttgcttgatgatgaagctgtgactgttggaggtacctgccatagccatgcgacaaaggatctatatgattccattgcagctgggaattaccctgaatggaagctctacatccagactatcgatcttgaccatgaggataagtttgacttcgacccgcttgatgtcaccaagacctggcctgaggatatcatcccactgcaacctgttggacggatggtcctgaacaagaacattgataacttctttgcggagaatgaacaaattgctttctgcccagcgattattgtccctggaatccactattctgatgataagctgctccagacgagaatcttctcctatgctgatacccagaggcaccgccttggtccaaactatctgatgcttcctgtgaatgcaccaaaatgtgcccaccacaacaaccaccatgaagggttcatgaacttcatgcacagggatgaagaggtgaactacttcccttcaaggtttgatcctacccgtcatgctgagaaggtccctattccttcccgtgttctaacaggctgccgcgagaagtgcatcatcgagaaggagaacaacttcaagcaggctggtgagagatttcgatcctttgaccctgccaggcaagaccggtttatccaacgatgggttgacgcactgtcagaccctcgtgttacccatgaacaccatacgatttggatcaactactggtctcagtgtgatgcctctcttggccagaagctggcttctaggctgaacctgaagccgaacatgtaagattgacaaggaagaaagcaggcgccggtggccgaggatgcaacatggagcgtgatgcaacacatgttggatcgtgcgatgttgagaacggctgttacacctatataatcgaataaacagggatgtgcgcgttgtagtatgctgatgatcggtggtggttatatatcctggaacttttggtgtacacatcttttctggaaagacgtaataataaagaagaatgtgtc

SEQ ID NO: 8670 - DNA, 1501 bp, Sorghum bicolor
ggcggcggcggtctccgtcgcgaggctaggccagcgggccgcacccatggcgtccgtggcggagctcaaggagaagcacgccgccgcgacggcgtcggtcaactccctgcgcgagcgcctccgccagcgccgggagacgctcctcgacacggacgtggcgaggtactccaagtcgcaggggaggctgccggtgagcttcaacccgacggatctggtctgctgccgcacgctgcagggccatagcggaaaggtatattctctggattggacccctgaaaagaattggatagtcagtgcctctcaagatggaaggttaattgtgtggaatgcattgacaagccagaaaacgcatgccataaagctgcattgcccatgggtgatgacgtgtgcttttgcacccaatggacaatctgttgcctgtggtggtcttgatagcgcgtgctctattttcaatctcaactctcaagcagacagagatgggaacatgccagtatcaagaattcttactggacacaagggctatgtttcgtcatgccaatatgtcccagatcaggaaactcgccttattactagctccggtgatcagacatgtgttctttgggatgttactactggacagaggatctcaatatttggaggtgaatttccatcaggccatacagctgatgttcaaagtgtgtccatcaactcatcaaatacgaatatgtttgtctctggctcatgtgatacaactgtgaggctgtgggatatcagaattgcaagtcgagctgttcgaacctaccatggacatgagggcgacgttaacagtgtgaagttttttcctgatggccataggtttggtactggctcagatgatggcacatgtagattatttgatatgagaacagggcaccaacttcaggtgtacagtagggtgcctgatagaaatgatgatgaactacctactgttacatctattgcattttcgatatcaggaaggctactttttgctggttactccaatggtgactgttatgtgtgggacacacttcttgccgaggtggtacttaatttggggaatctgcaaaactcccatgatggtcgtataagttgccttgggatgtcatctgatgggagtgcattgtgtacagggagttgggacaaaaatttgaagatttgggccttcagtggacaccggaaaatagtttgaaggacaacttttctcccccatgttgtatgttccttgtcatgccttaacaatggacaatggtgatcagtgatcgactcagacttgttcctgggaatccccttcttgtttttgtagtatagaatcttgtgcactacgccctatgtttaatggaaaaaagtgcaatttgtcttggcgctacatcttgttgagttagtaactgtttatactgttattacaagaatatcagtaacgtgtgatctgccctttctttgtacaaccattttacttttcagatttagataagtagcatgtatattctggaatcagtttatc

SEQ ID NO: 8671 - DNA, 885 bp, Sorghum bicolor
ctgccgccatggccgacgagatcgacacgaggccggcctccgcgggctcccggggccgccccgcgcacgctacggaggacgacgacagggaggagggagagatcgccgacgacacccccgcgcccgccctccccgtcacgcacccgctcgagcactcatggaccttctggttcgacaacccgcagggcaagaacaagcaggccgcctgggggagctccatccgacccatccacaccttctccaccgtcgaggacttctggggcctttacaataatattcatcaccctagcaagttggtcattggagctgacttccattgcttcaagaacaagattgaaccaaaatgggaagaccctatttgtgctaatggcggtaaatggaccatcagctgtggaagagggaaatctgacacactgtggctgcacactctgttggctatgattggcgaacaattcgactatggtgatgaaatttgtggagcagtcgtcagcgtgcgtggcaagcaggaaagaatagctatctggacaaaaaatgctgctaatgaagctgctcagataagcatcgggaagcagtggaaggaattcctggattacaaggactccattggattcattgttcatgacgatgcaaagaaggcggacaagggaccaaggaaccgatacacggtttgatcctgttgctggaaatctcagagtgtagcatgcgcacgtgtagggtggttctatccgaatctaatgcagacatgcagtagcaccttgcagagtttagactctagtgttgaaggttctctatttgctgaggagttgcttaagcataatctaacatgttgaatgtatttcctgtatgttccataaacataatctaacactcgggtgttgtttcgtc

SEQ ID NO: 8672 - DNA, 1146 bp, Sorghum bicolor
agactccaagctcctgtgtggcttctgtttctgctgccgcctcctggtccacatctctctccgccgccgccgctgccgtcgtcgtccgccgacaccgtagcgctgggaagggatcacacgggagcggcgacgcgaggcgggggacccgcggttttgtcgcccggatggcggcggagcgatgacactggcggcggcgggagcggcgcggcgttgggatgcggacgatctgcgatgtgtgcgagagcgcaccggcggtgctcttctgtgcggccgacgaggcagcgctctgtcggtcctgcgacgagaaggtacacatgtgtaacaagcttgctagtcggcatgtgagagttggacttgcagaccctaataaacttgcccgttgtgatatatgtgaaaattcacctgctttcttctactgtgagatagatggcacctcactttgcctgagctgtgatatgactgttcatgttggtggcaaacgaacccatggaagatacctgctcctaaggcaaagggttgaagagataaaccaggccatatggatgacgtgcctatggaaaccgtgcctatggaaaccaaagatcctgaaaaccagagagaccagaagaaggcgcccaaggagcaaatggcaaaccaccataatggcgatcacccagcctgtgatggcaattgcgatgaccagggcaacattgattcgaaaatgatcgatcttaatatgcggccagttcgtactcatgggcaaggatcaaattcccagactcagggggtagatcttagtgtgaacaaccatgactctccaggggtggtgccaactagcaattctgaaagagacgccagcaagtaaactttggaagatcagatgtacatttcaactacatatactgctctataggagctcatggggggcagaaatggggttattcagtggtctctctgttactattactagtaagtatatttctggcagagttggagctaacgaccgcatctcaattcggcttgtcgtgcccattgcattctagctgcgaacttgcgattgtcagaactcatgtagaagcgcagctgctgtcgcctgtgcttcggagtcggagtattgtgtgccattagaaactgtacaaaagattaatagaccggtctctttttttt

SEQ ID NO: 8673 - DNA, 661 bp, Oryza sativa
gccggattggtagccgccctgctcgtgctgcattcgctagccacgccgtccgctcaggccgaggcgcatcgcgcagggggagaaggggaggagaagatgtcgagcgacggagggccggtgcttggcggcgtcgagccggtggggaacgagaacgacctccacctcgtcgacctcgcccgcttcgccgtcaccgagcacaacaagaaggccaattctctgctggagttcgagaagcttgtgagtgtgaagcagcaagttgtcgctggcactttgtactatttcacaattgaggtgaaggaaggggatgccaagaagctctatgaagctaaggtctgggagaaaccatggatggacttcaaggagctccaggagttcaagcctgtcgatgccagtgcaaatgcctaaggcccatctcgtatcctatgtgtatcaagttatcaagaagatggggaataatatggtgtggatatagctattggacatgttaattatccacatgataatatggcttggatataaggatctcacacgataatatggcttggatatatagctattaaagattttacctatggcatatttcaatgtgtattagtacttagtaagaatgattgcaaggtgtattaactacaaatattgcaataaaagtccctgttactac

SEQ ID NO: 8674 - DNA, 1218 bp, Sorghum bicolor
gtcgacccacgcgtccgcccaatcctccacgagccccctagcctgtcgccgcggcagccactactactaccgcgccccttcgcacgtcccgcgccgctcccgcccccgcggacgcggcggcgtcgtcagcctgcgtccgatggcctcgtcgacggcggctcagccccccgcgccggcgcccccgggcctgaaggagggcatcgcggggctgtacgacgagtcttcggggctgtgggagaacatctggggcgaccacatgcaccacggcttctacgactcgggcgaggccgcgtccatggccgaccaccgacgcgcccagatccgcatgatcgaggaggcgctcgccttcgccgccgtcccatccccagatgatccggagaaggcaccaaaaaccatagtagatgttggatgtggcattggtggtagctcaaggtacttggctaagaaatacggagcacagtgcaaggggatcacattgagccctgttcaagctgaaagaggaaatgctcttgctacagcgcaggggttgtcggatcaggttactctgcaagttgctgatgctctggagcaaccgtttcctgatgggcagtttgatctggtatggtccatggagagtggcgagcacatgccggacaagagaaagtttgttagtgagctggcacgcgtcgctgctcctggagggacaataatcatcgtgacatggtgccataggaacctcgaaccatctgagacttcgctaaaacccgatgaactgagtctcttgaagaggatttgcgatgcgtactacctcccagactggtgctcaccttcagactatgtgaacatcgccaaatcactgtctctggaggatatcaaggcagctgattggtcagagaatgtggccccattttggcccgctgtgataaaatcagcactaacatggaagggcctcacctctctactgacaagcggatggaagacgatcagaggggcgatggtgatgccgctgatgatccaaggttacaagaaggggctcatcaaattcaccatcatcacctgtcgcaagcctggagcagcgtaggtgaccaaggggcagaagttactgtcaaagcacctctgctaagtccaataatgtagatccatggccccatcaccgtctattgtactgtactgtactgtaccagaatgaacagtctcctgggacatgttttccaaaaaaaaaaaaaaaagggcggccgc

SEQ ID NO: 8675 - DNA, 1685 bp, Sorghum bicolor
agagatagaggagcaatggctggttcgtcttcaatggacactgaagctgcaggccaacagctcaagcatggcagcggctacagcatcccggctactgctcatgcggtggacacagactcgtggcagcaggtgagcctgctgatggtgatcggcttcaactgcgcctacgtgctcagcttctccaacctcatgatggtgcccctgggctgggcatggggcgtcgcctgcctgctgctcgtcggcgccgccgcatggtacgccaactggctcctcgccggcctccatttcgtcgacggacagaggttcatccgctacagggacctcatgggcttcgtattcgggaggaacatgtactacatcacttggttcctgcagttcaccactctacttttgtgcaacatgggcttcattctactaggagcaagagcactcaaggcaatcaacagcgagtttacccacacccctgccaggctgcagtggttcgtcaccgcgacgggattcatctacttcgccttcgcctacttcgtgcccacgatttctgccatgaggaactggctcgccacgtcggccgcgctgacattagcttacgacgtcgctctgctggctatcctcatcagagatgggaaatcgaacaagcagaaggactacaacgtccatgggacccaagccgagaaggtgttcaacgcgttgggcgccgtcgccgccatcctcgtctgcaacacgtccgggctgctcccggagatacagtcgacggtgcgggagccggcggtgcgcggcatgcggcgggcgctgcttctgcagtacaccgccggcgccgcggggtactacggcatcagcgtggcggggtactgggcgtacgggtcggcggtgtcggagtacctccccaacgagctcggcgggccaaggtgggccgccgtgctcatcaacgccaccgccttcctgcagagcatcgtctcccaacacctgttcacggtgccgatccacgaggcgatggacacgcggctgcagcggctggacgagggcatgttctcccggtacaacctcacgcgacgcctctgcgcgcgggggctcgtcttcggcttcaacgtcttcgtcaccgcgctgttcccgttcatgggggacttcgtcaacctcgtcggctccttcgcgctcgtcccgctcaccttcacgttccctagcatggccatcctcaagatcaaagggaagagcggcgggagatgtaacagactttggcattgggggatcatcgttttctcctcggttctctgcgtcgctaccaccgccgccgccgttcgtctgatcttcaacaatgctaggatctaccacttcttcgctgacatgtagtaaggagtccaaaaaaaacacgattaggtgatattgccacttctcaattttttttttttgttttggtgaggaatgaaagggtcacctcatgtttggtaaggacgaccacatgcatgatcaataagcatcatgtagtcatcctatcgaaatttagaaatgagcttattgtggtggaccacctcctcaaaacaaagatctctgttcttaattaatgcgagcttaaagacaactcatgcctatatatatatatatatatatatatgctctcaagctcatgcctatatatatatatatatgtaatcgccctcaagtttattaatcaattattgtgtatttagttc

SEQ ID NO: 8676 - DNA, 1161 bp, Sorghum bicolor
cggcgtcgtcagcctgcgtccgatggcctcgtcgacggcggctcagccccccgcgccggcgcccccgggcctgaaggagggcatcgcggggctgtacgacgagtcttcggggctgtgggagaacatctggggcgaccacatgcaccacggcttctacgactcgggcgaggccgcgtccatggccgaccaccgacgcgcccagatccgcatgatcgaggaggcgctcgccttcgccgccgtcccatccccagatgatccggagaaggcaccaaaaaccatagtagatgttggatgtggcattggtggtagctcaaggtacttggctaagaaatacggagcacagtgcaaggggatcacattgagccctgttcaagctgaaagaggaaatgctcttgctacagcgcaggggttgtcggatcaggttactctgcaagttgctgatgctctggagcaaccgtttcctgatgggcagtttgatctggtatggtccatggagagtggcgagcacatgccggacaagagaaagtttgttagtgagctggcacgcgtcgctgctcctggagggacaataatcatcgtgacatggtgccataggaacctcgaaccatctgagacttcgctaaaacccgatgaactgagtctcttgaagaggatttgcgatgcgtactacctcccagactggtgctcaccttcagactatgtgaacatcgccaaatcactgtctctggaggatatcaaggcagctgattggtcagagaatgtggccccattttggcccgctgtgataaaatcagcactaacatggaagggcctcacctctctactgacaagcggatggaagacgatcagaggggcgatggtgatgccgctgatgatccaaggttacaagaaggggctcatcaaattcaccatcatcacctgtcgcaagcctggagcagcgtaggtgaccaaggggcagaagttactgtcaaagcacctctgctaagtccaataatgtagatccatggccccatcaccgtctattgtactgtactgtactgtaccagaatgaacagtctcctgggacatgttttccaattgccatgacatgtcaaatgatcttctaccactcctgtaccagaatgctttatttactcatcttgctcagccctatcaccggcc

SEQ ID NO: 8677 - DNA, 2521 bp, Sorghum bicolor
caggaaacaaagcaagcaagcaagcatcgcacgaacgatccatccattcatcgcctctctctgtctctctttcagcaacaagaaagtctcgtaggtagagatcagagcaagcacaagcagaagcagggcaatcaatcatggcgtctgcggacgtgcacatggccggcggcggcgcggagacggagaccttcgcgttccaggccgagatcaaccagctgctctccctcatcatcaacactttctactccaacaaggagatcttcctcagggagctcatctccaacgcatcagatgcgcttgacaagatccggttcgagagcctgacggacaagtcgaagctggacgcgcagccggagctcttcatccggctggtcccagacaaggcaaccaagacgctgtccatcatcgactccggcgtggggatgaccaaatccgacctcgtcaacaacctgggcaccatcgcgcggtcaggcaccaaggagttcatggaggcgctggcggcgggcgccaccgacgtgtccatgatcggccagttcggggtcggcttctactccgcctacctcgtcgccgacaaggtcgtcgtcaccaccaagcacaacgacgacgaccagtacgtctgggagtctcaggccggtggctccttcaccgtcacgctcgacaccaccggggaacggcttggtcgcggcaccaagatcacgctgtttctcaaggacgatcagctcgagtacctcgaggagcgacgcctcaaggatctcgtcaagaagcactcggagttcatcagctaccccatctacctctggaccgagaagaccaccgagaaggagatcagcgacgacgaggatgacgaggacaagaaggagggcgacgtcgaggaggttgacgacgacgacggcgacaaggacgacaaggactccaagacgacgaagaagaagaagaaggtgaaggaggtgacgcacgagtgggtgcagatcaacaagcagaagcccatctggctgcgaaagcccgaggagatcacgcgcgaggagtacgcctccttctacaagtcgctgaccaacgactgggaggaccacctcgccgtgaagcacttcgccgtggaagggcagctggagttcaaggccatcctgttcgtgccccgccgcgcgccattcgacctcttcgacacccgcaagaagctcaacaacatcaagctctacgtccgccgcgtcttcatcatggacaactgcgaggagctcatcccggagtggctgggcttcgtcaagggcgtcgtcgactccgacgacctgccgctcaacatctcccgcgagacgctgcagcagaacaagatcctcaaggtgatccgcaagaacctcgtcaagaagtgcatcgagatgttcttcgagatcgccgagaacaaggacgactacgccaagttctacgacgccttctccaagaacatcaagctgggcatccatgaggactcgcagaaccgcgccaagctcgccgacctgctccgctaccactccaccaagagcggcgacgagatgacgagcctcaaggactacgtcacgcgcatgaaggaagggcagaaggacatctactacatcaccggcgagagcaagaaagccgtcgagaactcgccgttcctggagcggctcaagaagaaaggatacgaggtgctcttcatggtggacgccatcgacgagtacgccgtcgggcagctcaaggagtacgacggcaagaagctggtgtcggccaccaaggagggtctcaagctcgacgacgacgacgaggaggccaagaagcgccgggaggagcgcaagaagcagttcgaggatctctgcaaggtgatcaaggacatccttggtgaccgcgtcgagaaggtggtggtgtcggaccgcatcgtcgactcgccgtgctgcctcgtcaccggcgagtacggctggacggccaacatggagcggatcatgaaggcgcaggcgctgcgggacagcagcatgagcgcctacatgtcctccaagaagaccatggagatcaacccggacaacggcatcatggaggagctccggaaacgcgccgaggccgaccggaacgacaagtccgtcaaggacctcgtgctgctgctcttcgagacggcgctgctcacctccgggttcagcctcgacgaccccaacacgttcgccgcgaggatccataggatgctcaagctcggcctcaacattgacgaggatgctgctgccgacgaggacgctgacatgcctgcgcttgaagagggcgccgccgaggagagcaagatggaggaggtcgactgatgaggggtctgtccgtttgaggtagatccttcatccatcctgccaaaatcgatcgatcgatgagggtgatgcctctgctttgtgtgtctctgcgtgtgggtccatcaagtgtcactgttggtacagcaggtcacagtattcagtagtagtagcttaccatgtcttgtgtcttgttcgtgtcacatttcggatccgctgtgtcatgccaatgctgtggaacataatataataat

SEQ ID NO: 8678 - DNA, 1435 bp, Oryza sativa
gtcagttcccgcgccgtgtgaccaatactcaacacttaaaccgcgcgctttttagccgacccgagcagccggagagtgaggcgaggcgaagcgaagggaagagcgcgaggcagagtaagcagacgagaagaacagcgcgcggcgcggtagctgaggagagtggtgcggagatggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggccgggctcgccaagctcatcgggctggccggcgagaccaacgttcagggagaggagcagaagaagctggacgtgctgtccaacgaggtgttcgtcaaggctctcgtcagcagcggccgcacctgcgttcttgtctccgaggaggacgaggaagcgacgttcgtggaccctgcgctgcgtgggaagtattgcgtgtgctttgatccactcgacggctcctccaacatcgactgtggcgtctccatcggaacgatctttgggatctacatgatcaaagataaggagaatgtgactcttgaggacgtgttacagcctggaaaaaacatggttgctgctggatactgcatgtacggcagttcctgcacgcttgttctgagtactggaaatggtgtcaatggcttcacacttgatccatctctcggggagttcatattaactcatccagacatcaagataccaaagaaagggaagatttattcagtgaatgaagggaatgcgaaaaattgggacgagcctaccgcaaagtttgtggagaagtgcaagttccctaaggatggttcatcacctaaatccttgagatacattggaagtatggttgctgatgtccaccgtacgttgctatatggaggagtatttttgtaccctgcagacaagaagagcccaaatggaaaactccgtgttctgtatgaagttttccccatgtcattcctgatggagcaggctggaggccagtctttcacaggcaaagaacgggctcttgacctcgttcctaccaagattcacgagagatccccaatatttcttggaagcttcgaagatgtggaggagatcaaagggttgtacgctgcacaggcgaagtaagctcggtttgatcgatctggcaccatcaaggcgtgcgaatggactccctggccttactgtaacatgcatgattcgtcaggcacttcttttattcgtcttactgtacgtttgtaaaattcagtgtaatagtgttgaggcctggaacagcttcatgagcaactaaggccttttctactattatttacaaaatacatacaccgtgcatctctagcagctaaagcactaatacaacaagtcactaaggc

SEQ ID NO: 8679 - DNA, 692 bp, Sorghum bicolor
cgcgatctagaggagcaacaaccattcggcggtgcaagtgctactcctgctccttcccactagcggtagtgcccgtcgtctcgccgccgcctcctctccctccgggctcccgccgccggaccgcgtcgtcagcgatggccgaggcacacagcgggcggcgcgtggggatggtaggcgacgtccgggacgcgccggagggccacgagaacgacctcgaggccatcgagctcgcgcgcttcgccgtcgacgagcacaacagcaagaccaacgcgatgctggagttcgagaggctggtgaaggtgaggcaccaggtggtggccgggaccatgcaccacttcaccgtccaggtgaaggaggccggcggcggcaagaagctgtacgaggccaaggtgtgggagaaggtgtgggagaacttcaagcagctgcagagcttccagccggtcggggacgccgcggtcgcctgaggtagtgaaggtatcatcttccagtgccatgatgtgtttttcccctcgaggctcacaagcttttggctgggggctggagcacaagaatgaaagaatttagccgtcggacatggaatacatcccccactgggaaagtatatatgatatgatgaataaaccagcatcttaccacatgtattgtacgctgtatgaaatatcgactcctgtaatggaatgagctgtgctaag

SEQ ID NO: 8680 - DNA, 1471 bp, Sorghum bicolor
gcgagaaacaacgcaagcgaaagcagagcagaaggaaagcgagaagccagagcagcgagcgaagcagcaagcaagctagagcagagagctagcaagcacgccggcgagcgagagcgagagagaccaggcaggcaagatggtgcagcaacaagcagcgaaggaggtgatcccgctgctgacgccttacaagatgggccagttccagctctcccaccgtgtggtgctcgcgccgctgacgaggtgccgctcctacggtaacgtgccgcagccgcacgccgccgtgtactactcgcagcgcgccaccaagggtggcctgctcgtcgcggaggccacgggggtgtcgcccaccgcgcaggggtacccggagacccccggcatctggacgcaggagcaggtccaggcgtggaagcccatcgtcgacgccgtccaccgcaagggcgcgctcttcttctgccagatttggcatgtcggcagggtctccaccaccgagcttcagcccgacgggcaggcgcctatctcgagcacggacaagcagatttccccggacgccgagtccggaatggtgtattcgaagccgcgccggttgcaaaccgaggagatccccgggatcgtcgatgatttcaggcgtgccgcgcggaacgcaattgaagccggcttcgatggtgtcgagatccacggcgcgcacggatacctcctcgagcaattcatgaaggagagctctaacgaccgcaccgacgagtacggcggcagcctggagaaccggtgccgcttcgccgtggaggtcgtggacgccattgtccgcgaggtgggcgcgcaccgcgtgggcatcaggctgtcgcccttcgtggacttcgtggactgcgtggactccgacccggtggcgcttggccactacatgatccagcagctcaacaagcacgagggtttcctctactgccacatggtggaacctcgaatggcgattgtcgacggccgcaggcagatccctcacaggctcttgccgttccggaaggcgtctcacggcacattcatcgccgccggcgggtatgatcgggaggaaggcaacaaggtagtggcagaaggctatgctgaccttgtcgcatatggaaggctcttcttggctaacccggacctgcctaagaggttcgagctgaatgcgccactgaacaagtacgaccgttctacgttctacacgcaagatcccgttgttggctacacggattaccctttccttgaagacaattgcgataatgatgagtcaagtaatcaagcttaatcatgcaaatcgtttggttcatcaagtaggagtatttatatcattatttccaccatcctttattgacattgtggcagattcattacatcgtgtggtttcattctgtattaagtgtgaggtgaaataaatgtacttgatgaaattattagtcttggtttcaatttgttcaagaaatctcagagactcatgagtcct

SEQ ID NO: 8681 - DNA, 1080 bp, Arabidopsis thaliana
ggaccataaaacatttattttgcgcctataaaggcatttcagctccaccgtaggaaactttctcttgaaagaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctcccggcgaagaaggtctgcgttgtctctcagagtgagagcgagttaagtcagccgagtttcccggtggagtgtataggatttggaaatggggacgagtttcagaacctgaattacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaggttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatagaaaaacttacatgtgtaaataagatttgtaatgtaagacgaagtacttataacgt

SEQ ID NO: 8682 - DNA, 2145 bp, Gossypium hirsutum
ttcgagtcccaaagccacagtgaaagagaagagaacaacatatactcgataacatttttatagaggcagaaaagatacagtttttttggttggagaaggttgtgaaaaaagagtaatagattgtgttgataaaagagatcgtcgtcatcatcatcagcaccatcatgagtaattggttggggttttctctgactccagaccttaggatcgatgaaagctttggcagagaagaccatggaggtttcccttctgtcatgcctttgcgttctgatggctctctttgtgttgttgatccttttcgtcgctcttctattgctgccgatgaagattggagatatgaaaatggtattggatctgcaactgcaaatgagcagggtcccaaacttgaagatttcttgggttgttactcaaactctccatctcaggagaccaaagcttattgtggaacacacgaaaaccaaaacactgttcctagtcctactagaatcaacgtgaatgtagcaccaaattatagcagtagtggggatgcggaagctgcagagaatttcacaaatccatcgtctttcatccaaacttaccgaaattacaacgaaaaccctcaaaccctaatggctggtggtcacagcctccaacagtgtgacccaaaccctaaccacaaccaaaggagtggcgtgcaccatgttccttttgagagtgcaacttcagtttcaggattcaaatcctggttgagacaaactccatttcctggtggaaaagcttcgggtaatgaaacaaataataactttaactttcaggcactctctcttaccatgagcccaacctctcgaaatgggttccctgctatagcaccattggaggtggttgataaccgtaaacgacctgtcggaaagaacctcaccagggaatcagttcctcgcaaatctattgatacttttggtcaaagaacttctcaatatcgtggtgttacaaggcatagatggaccggaagatatgaggctcatttgtgggataatagctgtagaaaagagggacaaacaaggaaagggaggcaagtttatcttggtggttatgacaaggaagaaaaagcagcgaaggcttacgatttagctgctctcaagtattggggtccaacaactcatataaatttccctttgagtacttacgagaaggagctggaagagatgaagaacatgacccgtcaagaatttgttgctcatttgagaaggaaaagcagtggtttttcaagaggagcttcagtgtacagaggagtgacaaggcaccatcagcatggaaggtggcaagctagaataggaagggttgcgggaaacaaggacttgtaccttggaacatttagcacacaagaagaagcggctgaagcttatgatattgctgcaattaagtttaggggaacaagtgcggtgaccaattttgacataagtaggtatgatgtaaagagaatttgctcaagctctacacttattgggggcgaacttgcaaaacgctctccaaaagacactgcctccattgctcctgaggactacaattcatgtgcttcatcagcatctcctcaacctcttctagctataccaagcggtgaagcatcagatgaattggcggacatggtttggactgcaaattcagatgagcaacaacaacatcaaagtactaacacaaataatgatgcatccttggcaaactcaagtagccgcaattcctctaacccgcaaagcccgaaaggctccattggtttagctagtgataagtttggcattggcggagattactctcaccacggctacttctcattaaagggttcaaaatacgaagatggcaacagtgagactgataattccaatgaaaatcggctaggcaatttgggtttagttcataagatcccaatgtttgcactttggaacgagtgagatagtgaatttcacaagaatttgagacacttatcagcgatagagaagtttagttttagtttcttcactaaagaaaactggttagaaagagggtaggatatgtaacacaggatatcatggaattcaatggtctttaattagtgctttaattccgaatgaaattaactaactgttctctaccttatcaaaatgtctaatacaaagatgaggcaattggtttgtt

SEQ ID NO: 8683 - DNA, 972 bp, Zea mays
cattctccccacctccgccgccgtttccccgcgtgctttctctctctctcgatctcgagcgacgactcggttacagccgccgtcctacgccaggttccaggtcttcgtcgggcccttctccggcaacgagcaccaacaagatttttgtgtgtaaagatttgcgagcaccattcacttttacatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattgtattggtgttggctacctggtcgaatggtcgtcgctccattttgttggtgacttaacaatttcaattgagaaaatatgtttcaaaccgagcaatctgcttgatgctgaaatcagttattcgccaagagtgaatcttcctatc

SEQ ID NO: 8684 - DNA, 906 bp, Zea mays
agccaccagctaccaatggcggccaccgcgatggaccatgacggcggcgacgacgtggtcacaccaggggagcttctcggaaactcattaaccctcgcggccggacgtggcgcctacgccgacggtcgctctgtgcgcgcgtcggtcaccgggcgccgccgcatcgtgccgcccgcacctgcctccgacgaccagagatccacggtggaggtggtggggcacaaggcccatggagctgtgccgcagccgggaagcgtcgtcatcgcccgagtaacaaaggttatggctagaatggcctctgcagatatcatgtgtgttgactcaaaggctatcagagaaaagttcactggcatgataaggcagcaagatgttcgtgcaactgaaattgacaaggtggatatgtaccaatcatatcgtcctggggacattgttaaagctatggttctttctcttggtgatgcaagggcatattacctttccactgcgaaaaatgaacttggagtcgtttcagcacaaagcatagctggtggtacattggttccaatcagttggactgagatgcaatgtgatttgaccggtcaaattgagcaaaggaaagttgcaaaggtggaatagatgtgctgtggccctcctgataaatggtaaacatgtggtggcggtatacaaattgtggaccagtgacaccaggtccttgggcggactacccaattctgcgacgtccaacttcattacagctgcattgagcatgggtttttaaaaccctggctgaatttaactagacatgaatcgtagccatgggtcctgtaacccaaccttgggatctgaatcatagccatgggttctgtaacccagtaaccttgcccttgtgatttgttactctgtgagctaatgacattgcagttttcc

SEQ ID NO: 8685 - DNA, 1287 bp, Zea mays
cgacgcgcccaaagctcacgccggacctgctcctctccgacggcggcatcggcttcgtgctccgctactttcccaaggcgttcaagccccgcccccgcccaggccacgaggtggacgacctcgccaacctcatcaagctctacgcggactggcactcccgcctgatcccctactactccttcgaacagttcgtgcgcaaactcgagaaattgggtgccggcaaccgcgtcagggacgatggtgggcctctctgaaggggagaaacacttcatccgcggcggcattgcacaagacgttcgcactgatggacgtaggcggctgcagttccggtccctctccgtccaaaccggagtcattccacaggcgaatggctcagcgcgtgttaggttgggggccactgaaataatcgctagtgtcaaggctgaactaggaaaaccaagcattcttcaccctgacaaaggaaaagttgctatttttgtcgactgtagtccaaccgctgagcctctgtttgagggtagaggctctgaagaattgtctgctgagctctctgtttccctgcaaagatgcttgttgggtggtaaaagcggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagtttgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaacactctatatttacaaagtcattttgctctctatatttacaaagtcattttgctctctatatttacaaagcatgaatgaagatacccaagaacactcccgcacct

SEQ ID NO: 8686 - DNA, 1803 bp, Zea mays
cttcccccgatttcaccgaccattttccccattttacagcggcgaatatctctcatctcccccgtcctctttgctgcaacacctcctacccacccgacagaaatatcctaagcgccgacccgaatacccgattcgctcctcgtccggtcgattcctgctcctaatcgctcgaatcgagtccttgccccgtgttccgtgccacaatctgggcgcttggctcccgcgagccggggttcttgggcctgggcggaggccatggacaagccggtggcgccgggcattatcaaggaggagctcctggagcagcagccgccgacgcaggacggtgtgggtggcggcggggatgcgccgcgcccgatggaggggctgcacgaggtgggtcccccgcctttcctcaccaagacgttcgaccttgtggaggacccggccaccgacgccgtcctctcctggagccgcgccggcaacagcttcatcgtctgggacccgcacgtcttcgccgacgggctgctcccgcgcctcttcaagcacagtaacttctccagcttcgtgcgccagctcaacacctatggcttcagaaaggttgatcctgacaggtgggagtttgcaaatgaaggtttcctcagaggtcaaaggcacctgctgaagatgataaagagaaggaagccaccatcagctgtggcaccattgcgacagcaacgtgcccctgcttcttgcctggaggttggtgagtttggatttgaggaggagattgataggctgaagcgtgacaagaacattttaatcacagaagtagtaaaactaaggcaggagcagcaaagtactaaagatcatgtgagagccatggaggaaaggctacgagtggctgaacagaagcaggtacagatgatggggttcttggcaagagcaatgcggaacccagagttcttccagcagttggcccagcagcaagacaagaggaaggagctcgaggataccatctcaaagaaaagaaggcggcccattgacaacacaccattctacagtgatggggaaagcgaacagcttgattcacagttgaaaatgttcgagtcaggtgttctcaatgggctcaatgaacctgagctggagaatttagcagtgaacattcaggagcttgggaagggaagcatagatgatgggaacttgactcaagttagtgaccagtcagagctgaacgacgacttctgggcagagcttttggtcgaagattttggagacaaggcaggacagccagagttggagggaagaactgaagacgtgaatgaccttgctcaacaactggggtatctgagttcttctagcccaaaatagagccagttcctaatggttgcccccacaatcactggtgctttccctaccctactgttgcagaccatcctgatcaaaccggaatgatgatggatctggcagacaagttgactggtggtggagaggtgttcatactgaaggcgtgctgtggagaggtcactgccttgacgttgaaggcttagcgctgtactctgctgtgggagttacgtgtggggtgttggctaaatgtctcttccggcgtcttctggcaaaatgatctcgtggacggtgactggcaaagatgcctaggggccaacgtatacgtacacagctgttatcagatcttgttcaaagtcattgcgcggttttgacggtgctatgtatcgatcagggttctggccttctggggttgggttgtagaattgactggctgatctagtgttctccatgtatgactggtgtaaccttaaaacaccctcagcttgttgttgaactgtg

SEQ ID NO: 8687 - DNA, 1675 bp, Zea mays
gtccgacgagccctagggaacgcgagaccggccgtcggcgagagaaggactcgaatggagtgcgcaagggagttgcgggttcgctccacgtttacggcggcggccatggcgtccaagaagcaggtggggcctggaggcgcggttcccgctcaggaacagatgaacggcggcgatgccgccagactggtcaggaagccaatggatacatttccacagccagcggcggcaagaggccgtagggcacttgtcgacgttggcaatcttatgaatggccggccttctcttgtgaaccatcagaagcaagcggttgcggcagcggcaaccagtcataaaccactcaacgtcggcaacaagaagccacttgttcctcaggcagcagcaagaggcctgcgaccccttgccgacgttacgaatcttatgatcaaagaccgtgctgctcctgcaaatcgtcagaagcctgtggatgctgtgtttaacaggaacgggaaggcagtaaagctgaaggaatgcaaggtgaagcctgaagtcattgtgatcattccagattccgagaaggagaagaaaggcaaattccctggaggtcagagagtctgtaggagggtgccaacactttttgacaatttgacaaaatgcagcagggcctctgatgggattaccaccccgaagaagaaggatccatatgacattgatgcacctgattcttgcaatgagctggcagtcgttgaatatgttgaggacatttacagattctacaagagcactgagggcacctgccttcctctcagcagctacatgagctcacaggctgaaatcagtgagagaatgagagctatccttattgactggattatcgaggtacagtacaggcttactctaatgccagagacactttacttgaccgtctacatcatcgaccagtacttatctatggagagtgtaccaagaaaggagctacagctcgtcggcataagtgccatgctgatagcaagcaagtacgaagagatatgggctccactggttaaggacttgatgtgcctatgtgacaacgcatttaccagagaccagattctgaccaaggaaaaggccatcctggacatgctccattggaacctgacggttccaacaatgtacatgttcattgttaggtacctgaaagccgcaatgtgtgacgcagagcttgagaacatgacattcttctactccgagctggcattggtccagtacgcgatgctggtttaccctccatcggtgaccgcagccgctgccgtctatgctgccaggtctacacttgggatgaatccacagtggactgatattctggaacatcacactggcctagctgagccacagttactggactgcgctaggcggctgatcagcttccatgccctggctccggaaagcaagcaaaaggcggtgtacaggaagtactccaagcccaagctcggctccgtcgcgcttcaatcccctgacaagaagctgttgtcaggttgaggctcgctgctgctcattgtattgtatatcatcgcttcgatggtaccatttgtttgggtcgtgtgctcttatgcttttctactgaagcagagcatgtgttggttagtcagtttgcttaaacgactactgaagcagagccttgtatgtgtgttgggagaatgtgatatgtgatgtcaagctc

SEQ ID NO: 8688 - DNA, 1305 bp, Zea mays
cgacgcgcccaaagctcacgccggacctgctcctctccgacggcggcatcggcttcgtgctccgctactttcccaaggcgttcaagccccgcccccgcccaggccacgaggtggacgacctcgccaacctcatcaagctctacgcggactggcactcccgcctgatcccctactactccttcgaacagttcgtgcgcaaactcgagaaattgggtgccggcaaccgcgtcagggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgatataatcgctagtgtcaaggctgaactaggaaaaccaagcattcttcaccctgacaaaggaaaagttgccatttttgtcgactgtagtccaaccgctgagcctctgtttgagggtagaggctctgaagaattgtctgctgagctctctgtttccctgcaaagatgcttgttgggtggtaaaagtggtgctggtgctgcaattgatctgtcatccctaattgttgttgatggaaaggtctgctgggatctgtacattgatgggcttgtggtcagttctgatggtaatttgctagatgcgctagctgttgcgataaaggttgctttgagtgatacaggtataccaaaagttaatgtttctgttagtgctgcatctgatgaggaacctgaagttgatgtaagtgatgaggaatttctgcagtttgacacatccggtgtgcctgttattattacattaaccaaggtgggtcggcactacatcgttgatgccacctcagaggaagaatcccagatgagttctgcagtgtcggtgtcagtcaacaggcatggccagatatgcgggcttaccaagaggggaggggcagggctggatccaagcgtcatcttcgacatgatatctgtcgccaagcatgtgagccagcagttcatctccctcttggattcagagattgccgccgccgaagctgaagaagaggctcagtgattgatgaaaaggaaaaaggactggttgcgtaaatgctcgtgtgttccaacttcaaccaaatgctgtagaaatcttcaggaatttggttccatttttatgttattattagtagtagtaaacaccgaggatttggatcctgggaacgaacgacgtcgtgttggctttggctgggctcagaggaacgaatactgaatcttgggtctg

SEQ ID NO: 8689 - DNA, 1455 bp, Zea mays
ggagtgcgctcgacggccgccgccattagtgatttagtgttgaagagggagagaatctaaagtgaccggacgctgtccttccttgctgatcggcgacacggtccatccctccctcgctcgctagggttccttttcgtccatggatcagagcttcgggaatctcggggccggagctgggagcagcagcgggggctccaactccaaggcggcggcagccgccgtgtcctcctcgtctttcctgcagctgccgctgtcgacggcgtcccccgcgtactacggcgcgccgctcgcgcttctgcaccacgccgccgcggccccgtcgtcgtcgcagcagcagcagcagcaccaccaccaccagtacgccaggcacggcgccgagatgtcggcggcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctccttagcgcgcctctcgctcgccgatggtaaatcagaaggtgttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccatcggaggacatgcctttcgtgatgatggaaggcttccacccgcagaacgccgctgctctgtacatggacgggccgttcatggccgacggcatgtatcgcctcggttcatgaactacacacttccatggacgactgtgggggcctatccaatcgtcggaccgtgggagtatatttcagtgttgcggtgcaaggacattgttgtggaatttttgttgctgattgccaaggggtgggtcggtcgatgtagcgtctatgcatggcttgtagttctcctgtaatgttgttgttaatttccgcttggcggcttgtaatctaggtgtatctctggaacttgaatcctgggtgattaatccggcaagcagctgcctgtttgt

SEQ ID NO: 8690 - DNA, 1009 bp, Zea mays
atccgacggccccgcgcgcgcgttctcacccgaccctgctcttcgcctcggctgctctaccagtctacctctaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcgcgtaaatggactcatcatgtgaccactctattgttctttgtatttggtatttggtcattgtgggaaggcttcaaggaagatggagattcagaagaattggctgaagttgaagcagagctggatgatgtctttaagagtaataaaggcgaatctaaaaataaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggtggaatcatagcgcaagcactctgcactactgctgctgttcttggtggaaagagcctagcctcccagatatccgagaagatggtcgaactgtcaagcggagtgctcttcctgctgttcggtatcatgtcattgctctctggaccaggagaattgtaatccctgcttgaacccttttcagctggctgattgacatctctctctccttagacctatcttatttcagtagatgaatgatggcgacaaaagccatccatccatatggcgaaccggatggtgattcgatagtttagccgacacatcggaaacatttcactcgtccttcataaataactacatgttacag

SEQ ID NO: 8691 - DNA, 2032 bp, Zea mays
ctagattaagcttgctgcttgacttagtagtgtaaatctgtaaagaaaattacctggtttgggtttagtctctataaaagaaatggaacagaggaatgttctggcattgggtgaacatgttctaaaagctactgtttggaagcggaagcataagactgctatggagcaccctgaaggcaatgatgtgatggtgttctctcagcatgatcaaagaaagcaccctgtgatatttgacgacagagctaaatgtaagaagtctaaattaatttcctgtgggagtggagttatattggagtcatattggaactttaagacaagtgggctgcctgtgcgcgtgcttttctaccaacatggtgactggagtgattttccagaggatgttgtaaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagaggatcaatgatattgcagaggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttgtcttgctcctgcaaactgtacaaattcatgtgccagatattctgattttcatgaagatggcatcatcagaatgatgttgtgccgtgtaataatgggtaatgttgaggttgttttgcctggatcaaagcaatttcagccatccaatggaagttttgataatggtgtggatgatcttcaaaatccacagaattacatcgtatgggatgctaatgtgcataaacacatatatgctgaatatgctgttattgtccaagcacctctcgtgaccaatgaatgttcgggcttgaaggatagcgtgcccaacatatctgagatcataagttctggttctcgagacaatctaaccaaggaggataggttcgcgccttgtggtgtcgaacaagaagcacctaggctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgacctggtggtacggatgaggcaaatagtcggtgataagatattggtttctacaataatgaggcttcaccaccagaagaagcccccatcgatggcagcagcagcagctgggctagcaagagcactcgcaaggggggaagagggagggggagtagccgagtaagattagtttaagccgccttgtcttttgagaaatttatggagcacatatgctttgtcgacatggccagacccaaggtgtcaaaagggagggagatgagctgagcaactgttgtagtgtagtctcaaactcaaagcgtttaggtcttgacatttgacaaactaaaactcagaaacattatcatgagtagtgttttttttttcgtttctc

SEQ ID NO: 8692 - DNA, 967 bp, Zea mays
ctcccgtgtgggtgcattctccccacctccgccgccgtttccccgcgtgctttctctctctctcgatctcgagcgacgactcggttacagccgccgtcctacgccaggttccaggtcttcgtcgggcccttctccggcaacgagcaccaacaagatttttgtgtgtaaagatttgcgagcaccattcacttttacatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattgtattggtgttggctacctggtcgaatggtcgtcgctccattttgttggtgacttaacaatttcaattgagaaaatatgtttcaaaccgagcaatctgcttgatgctgaaatcagttattcgcc

SEQ ID NO: 8693 - DNA, 831 bp, Zea mays; identical to SEQ ID NO: 8259

SEQ ID NO: 8694 - DNA, 1226 bp, Zea mays
ctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctcggcgacgacgagttcggccgcatgctcgccgccatcctccgcgacaacggcgtcgacgacggcggcgtcgtcttcgactccggcgcgcgcaccgcgctcgccttcgtcaccctgcgcgccgacggggagcgcgagttcatgttctaccgcaaccccagcgctgacatgctcctcaccgccgacgagctcaacgtcgagctcatcaagagggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccagggatttccatggcgctgtgccttccttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaagggggcgatcccgtcgctgcccaccgaagcggaggtcttgcagctaatagagaaggcttagatcatcatcgtcctgtacgccatggttttcaccagcttctacttcttcgaattgtattggattctgatatggaacagaagaagaagcggctgccccatcttaccagccctttttgtttgccctagtttccccttgtgaaaagggtgttttgttttataaactctacttgcaataagcagagccttttttt

SEQ ID NO: 8695 - DNA, 1432 bp, Zea mays
aaatataaaaaaaatcgaagcgaaagcgaggctgctgtctcacggctgcggctgcggcggttcgggctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccatcggactccaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtgtatattaacacggctcaagagtttgatggtagcgattctggagcacaccccgatgaagcagtctcatggggcaagattaagggttcagcaaaacctgtaaaggtgcattgcgatgcaagtatcgctttcccgcttcttgttgcagcaacatttgcacgtaaggttcataactccaaatgaacagactgaatgggattcggtggagtgaatgggcaacagaattttgttgaactctccaaatgaccttttggagcacgaggtctacttcacttgcacagggatcatgtgcaaattttttcggtgactcgcggcaaccacatgccatcattcttcgatgttcacttgatgctgtactagctggttgatagcatttttgttacaacagataatttattgaaatacagacatacgattgtcc

SEQ ID NO: 8696 - DNA, 924 bp, Zea mays
gccgatccgtgccctcacaccgcctacttgactcctcccgaacttccacatctctgctctgccttcccagtctcccatccctgaaaacctcacaaaaccctcgtttgctccccaccaccccgccgcgccgccgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagcgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggtggtatgggcggcatgggtggcatgggtgatatggctggtatgggtggtcttggtggcatgggtgggatgggtgatcttggtggcatgggtggtatgggaatggatgatttcgaagatgagagtgatgatgaagaagaattgtcgaaacctcaagctgcggacaaggctgttgaggctgaggagacggagtcagcggaaaccaagactgaggcggctcagagcagttgaagatgcttatgatctaagctagattgtatcctcatgttaattctgctgaatcggaggacaaaccttacatttgtggtgctggcaagtcccagtggcgtgccatgaaaatttacgttccgtcttttaactgggtatcctagtgtcgtgctcagc

SEQ ID NO: 8697 - DNA, 1273 bp, Zea mays
acccgttgctcccactccttccagaaccacctcctcgccaccgtggctgcctgccctgcccgctataagactcttcactcccgctgcgacgcagtcctcacaagcaccagaccaattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcaaaattatgagacagcgagtcaagctttaagagtt

SEQ ID NO: 8698 - DNA, 2343 bp, Zea mays
cagtgaggcacccctctcctggcctcttctcgccttctccgtttccgcgaacccagctgcctcgtagccccaccacaccgccgagcacgcggtctcccgcgccgccttccacccaagcgaagctacccctactcgacccagaattatcttctaccagcgctagtccgctccgcctctctactggctgccgtggagtggggatccgtccggacttccttctttcgctgttgatgtcatcatgctgagcattttgtggtagagacgatcatctctttgggttccagcatataactcatgcccataaaatttgcactagaaaatatgtcgacacaagcctctaaccggtcatacagatatccagacagaacccaactgccgtaccacaatggcaatccaatgcatgttgggggcaatggtaattactgtgtgcaacaaaatcacgatgatgttaactacatttcctctgatgatggatcacagagcagtagttctagagttcaagattttcaagcacagttttgcaccctagattcgtcttcggccaattgtgtttatcctgcacatagttctacctcttctcagagcataagtggaagccctctgtctcagcaggagagccactctgatcatgcatatggttcctctccaagtgcatcgtgcatcactcaggttcccacctggacacttaaggatctagaaaatgtgatgcttggacccgattctgacataggtagccctgacagttcctttctgcttgacactgccttgcatggaaataactggagagaacttttgggaattcaaactggggatttgaggcaggtaattgtagcatgtggtaaggctgttgacgagaatgctgtctatatggatgcattgatgtctgagttaagggagatggtttctgtctctggtgaaccgatgcaacgtctgggagcttacatgttggaaggcctcattgcgaggctttctttcactggacatgccttgtataaatctctgaagtgcaaagagcctgtggctacgagttctgagctcttgtcctatatgcatcttctttatgagatctgtccattcttcaagttcggttacatgtctgccaatggtgccatagctgaagcggttaagggggaagacattattcacatcatcgattttcaaatcgctcagggtagtcagtggatgactatgatacaggcccttgcttcaaggcctgggaggcgaccatacctaaggatcactggcatagatgactcgaattctgctcatgcccgaggtggtggactggatatggttggacagaggttgcacagaatggcccagtcatgtggtctgcccttcgagttcaatgctgtgccagcagctagtcatgaggttgtgtttgaagatctttgtctaagatctggggaggccatcgttgtcaattttgcttatcagctgcatcatactcctgatgagagcgtgggcatagaaaaccatcgtgatagaatactgagaatggtcaagagcctctctcctaaggtggtaactcttgtagagcaggaggcaaacacaaacacagcacctttctttcttagatacatggagactcttgattattacacagcgatgtttgaggcaatagatgttgcttgccccagggatgataagaagcgcattagcacagagcaacactgtgttgcaagggatattgtcaatttaattgcttgtgaaggtgcggaaaggatagagagacatgagccttttggaaagtggagggcaagacttgtaatggctggttttagaccatacccgttaagtccagtggtgaacagaaccatcaaaacactgcttgacagttaccacagccattacaggcttgaggagagagatggcatcctttatcttggctggaagaacagaaagctggtcgtatcttctgcctggtgctgatatttccaacttcttctaagaagcattgttaagattctttcgtggcttggggttcaggcgttcagcacatgaatccaaggtggaacctaaacttcagtatgaagactgcacaatcaaaaaaacaagctggttgcttccttactatttgttgcccagccttgaaactctcccacgctcactatcatcgctgatgtacttaccatgactcagttccatccttatatataggtgcaaacaatggtcttaatattgtatattggtagaatctggtggtattagcttccaaatctggattgctgaatcgtttgtgttactacatttagccaggatttgacagtagacacaaggagtgctgtaagatcctgtatgtacaacgtgcttcagttggtgtattgtacgtacttgggtgct

SEQ ID NO: 8699 - DNA, 1331 bp, Zea mays
ccagaatcactctgctgcaatccaaacatgctcttaatctaccgctgctgaaggaacaagatgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatggaaggaggccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaatcgcaagctatctgcaattcgtgccttcaaccctcagctttggagaggcattcatcagctgtaatggctgcttgccgtataaaaaaaggatggttcttgcctgttatattgtgttcagtgcatagccttgctccgtatgtccgtcgtatatataatcccttgcgtgtagtaagcgatgaactgaatgcatccagaatatcatgtcatgataaacttgaatatagtttcatggttgttatttcagactgaaaataaaatcagtcttctgttccggtt

SEQ ID NO: 8700 - DNA, 1785 bp, Zea mays
gccggcgagccccgctccgagcatctccgctgctgcttctgccgaatcccagagctccttctcccgcttgccccctttccctcctgtcacattgattcgattttcgtcgcccatggagctacaaattaagtgtaggaaccaattaaaagcttgccaaaactagggcggcggcatcagcattcagcaataccctaggcgggctctcctcgcctccacagctccaggaagccgacccagagcagcacagcgccgcccattctgtctctctcggtctcggcagcgtaggcagcgtcaccctccgcttaaaccaccagcaccagctgctggtgcgccgccccgcccggcaccgccgctcctctacctcttcctggtggattggtgagaggaagccctaacttggcctctcttgaatcaactcggcggtggctttgagtcagtaggtgttgttttgcgctcttattcaaaacccaaatctgtccctcctctcagattattgtgagtttatccctgccccaatccatctgtccatggtccgcgtgggcttgtcttccgcgcccggggtcaatctgacagagcaaatcgataatgtttttgaccaactgatcaacaagatagaacatgcggattttgatacgcggcctttcttgaaacaattgaatgtgttaggccgctatgaaccaatcaagcggaatgtatattgcactaagagacgcattgaagattatggcatttcttgtcactgtaagccttctcctggttcatcagttgtgtgtggcagagactgccattgtggcatgcttttctcttgctgttcatcacaatgtgaatgtgatgacacatgcaccaataaatcattccagcacagacctcttaagaaaaccaaattgattaagacagagaaatgtggtcatggattggttgctgaggatgaaataaagaaaggagaatttgttattgagtatgttggagaagttattgatgacagaacatgtgagaataggctatggacaatgaaaaggctgcttgacactgacttctacctttgtgaggtcagtagtaatatggtcattgatgcaacaaacaagggaaaccggtcccgattcataaaccatagctgtgaaccaaacacagcgatgcagaaatggactgttgatggagagaccagggttggaatttttgcacttcgtgacataaagataggggaggagctgacctatgactataaatttgtccagtttggagcagctcaagtttgtcattgtgggtcttcgaactgcagaaaaatgctaggcacgacgaagtattcaggaagctcacagaatcatcatgccaagaagaaaaagcggaaaacaagttgtgagaattgcatacagcagtttcttcggctgtggcatccacataaaaaaatgtatgttggttgttggataattgacttcgatcaagaaactaaaatgcatactctgaagttcaatgatctccatactgaaaagttcaatttgaaggaagaagaatggcacttcttagaggtcgattttgatgaagattgatcattgaaggtaactgcaagagttggctgccatggtttgtgacagggttgccatggtttgctgcaccgccggcctactagttgggggttcatttgcgatggcagcatagacagacggacggccatttttcttccattttggagtaatagtccaagcctgaactgtgacattcgtgcatgcttatacgtgaaagtgtacctgagagcagattatacgtgaaagtgtatcagcgttgcat

SEQ ID NO: 8701 - DNA, 627 bp, Zea mays
cagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgcc

SEQ ID NO: 8702 - DNA, 628 bp, Zea mays
ccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgcc

SEQ ID NO: 8703 - DNA, 1049 bp, Zea mays
gtccaaaggaaccctagccatgagcgccgcctccaagaagctcttccaggccgccaggtccctcgtcctctccgcttctcaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggcgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggcgatcttgccattgttgttggaagaaacattattcatggaagtgatggcccagagacagcgaaggatgagatcgctttatggtttgaacccaaggagctggtctcttacaccagcaatgcggagaagtggatctatggggtgaattaacgagagagtcaatctgttttttttcccttcttttgatctcggttttcacataattgccgacagacctaggcacaaggatgtaataaagtcgctaccgtcacttcgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggcgatgcagatgtttctttggatctatttctctagatatccctaccatgatgatggccc

SEQ ID NO: 8704 - DNA, 1145 bp, Zea mays
ttctaggagttgtactgagctgagctgccggaggcagaataggagaggcaggcgatgacgatggcgacgaaggcggcgtgcgtgctggcggtgtgggtgctcgtcgcctcgggcctgtgcgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagccgctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcgccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagagatcatgacacagttcgatgaatttgatgtgcctgcagctctttatacagcttaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataagaaacttatcgcccaaaaaa

SEQ ID NO: 8705 - DNA, 1761 bp, Zea mays
cgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaat

SEQ ID NO: 8706 - DNA, 994 bp, Zea mays
ctggggttcaagaccgaccagctccattgccaacgcaacagttccgatcctccacaccagcacccgccgccgccgcctcttcccttgcgcacctgctgctgtgcggatcggtgaggcggaggagtaggatggcgagcgcggccggaggcggagcggcgggggaaggggagtggcttaaggtatcccagctcaggcccatggtggaagcgcaggaccccaacgccaaggcagtggacaacctgacgctgcgtcggttcctgcgcgcgcgcgaccacgacgtggacaaggcctccgccatgttcctcaagttcctcaagtggcggagggaggcggcgcccggcggctccgtgccggaggagcaggtgaggagggagctgtcgcaggacaagctgtgcatgggcggcgtcgacagggccggccgccccatcctcgtcgccttcgcggccaggcacttctccgccggccgtgacatggcagagttcaagagttttgttgtctacttcttcgacaagatctgtgccagaatccccagagggcaggagaaattcctctgcatcgttgatctcaagggctgggggtactcaaactgtgacgtccgggcatacattgccgctatagagatcttgcagaactactacccggagcggctcggcaaggcgctgatgatccacgtgccctacatcttcatgaaggcgtggaagatgatctaccccttcatcgacaccaacaccagggacaagttcgtgttcgtggaggacaagagcctgcaggagacgctgcggcgggagatcgacgaggggcagctcccggagttcctcggcggcaagatggacgtgatcccactcaaggactatggcgtgcagcagcagcctcaggccgtgtaatagccatgccatgcgtagcatacacgagttgtggctaggagcatagcatggcaataactgtgtagctgctgtgaaagtgaaaatgaaacgttgcgctgtttagccgggtc

SEQ ID NO: 8707 - DNA, 2521 bp, Zea mays
ccctccctgttccctttcccacccctgcctgaggccttccgccttcgtctctgaatcgcggcggctcctgagtcccgaggcgccgcctgatgagcggctaggcgccggatctacggcagcgttggaggtctgatttggacgggagagagcgaggtgaggtctcggttttctcgatataggagatggcggcggcagaggcgcggggagcggacttccccgtggggatgaaggttctggttgtggacgacgacccgacgtgcctcgtcgtgctcaagaggatgctccttgagtgccggtacgacgtgacaacatgtccgcaggctacaagagcactaactatgttgcgagaaaataggcgtggttttgatgttataataagtgatgtccacatgccggatatggatggattcaggctacttgaacttgtaggccttgagatggatcttccggttatcagtcagtatatatttcttcttgtttttctgtttagtatgttaacatgtggtgttggaacacatcagaaataattgctgatgaaattgcagtgatgtctgctgattcaagaacggatattgtaatgaagggaattaagcatggagcatgtgactatttaataaaacctgtcagaatggaggagttgaaaaacatctggcaacatgttgttaggaaaaaatttaatggaaacaaggatcatgagcattctggtagcctagatgataccgatcgtaacagaccaaccaataatgataatgaatatgcttcctctgcgaatgatggaggtgatggcagctggaaatctcagaaaaagaaaagagagaaagaagatgatgaaactgacctagaaagtggcgatccttctacatcaaagaaaccaagagttgtttggtcagttgagcttcatcaacaatttgtgaatgcagtcaatcacctcgggatagacaaagctgttccaaagaaaattttggaattgatgaatgtccctggcttaaccagggaaaatgttgccagccatttgcagaaattcagactctacctgaagagaattgcacagcatcatgctggaatacctcatccatttgttgcgtctgcttctagtgctaaagttgctccgttaggaggactggaattccaagctttggctgcttctggtcagatccctcctcaagctctggctgctttgcaggatgaactccttggtcgacctacaagcagtttggcattgcctggaagagaccagtcatctttgcgactggctgcaatcaaaggaaacaagccccatggagagagagaaatagcatttggtcaacccatatacaagtgtcagaataacacgtatggtgcattttctcaaagcagcccagcagttggaggattgccatcttttgcagcttggcccaataacaaacttggtatgactgattcttcaaacacattgggaaatgtgggcaattctcaaaatagcaatatgttattgcatgaattgcagcaacagccagacaccttgctgtcaggaacccttcacaatattgatgtcaaaccttctggtgtagttatgccatctcagtcgttaaatgtgttcccggctagtgaaggcatctcacataatcaaaatccattggttataccatctcaatccccaagctttctggcatcagttcctccatccatgaaacatgaatcccttcttggatcaccttcaccatcaaccagtctgttgggtgggcttgatatggttaatcaagcttcaacaagtcagcctttgattagtagccatggagcaaatcttcctggtctcatgaaccgcagctcaaatgcaatgccttcaccaggaattagtaattttcaaagtgggaatattccttatgtggttactcagaatgctatgggagttagctcaagaccaccaggtgttctaaagactgagtgcactgaatcgctgactcatagttatggctatattggtggtagcaccagtgtggactctagcttgctctcttctcaggccaaaaatccacagtatggtttattgcagagtcaaaatgatgttagcagcagctggttgtcttcacaagattttgatagttttggaaattctcttgggcaaggccaccctggttccacttcgtctagcttccagagttccgctcttggcaaattgcctgaccaaggacgagggaggaatcatgggtttgtcgggaaaggcacttgcattccaagtcgctttgcggtggatgaggttggatctccaactaacttgagccacaacattgtaaacagtggagacatagtgaacccggacatattcggatttagtggacagatgtgaaactttcttgaatttgtaattagggttgatcagtgaggactggaaacaaatttagtggtttgaatggttgctcgtattttcgtttcttccttttccttctgtaattggtttataaggggaatcggctatgtgacagcatatggaatcttgctttatagaagtttgttcagtttaaaggacttgaaattaaaaaaa

SEQ ID NO: 8708 - DNA, 903 bp, Zea mays
cctccaccaccattcatcagaaagcgaagcaccagcctctgatgccaagccaaagcacacacacctcctccagcctttcttcctctacaaccccaattcttccctgcagctctgctgctgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggacagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgtctctcagagatatcccggtggtgatcatgtcctctgagaacattccttcaaggatcaataggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcagcagcagcgatagcataaacaaccgcaagagaaagggtgcaggcaccgaagaaatcttgccccagctggcaaacagatcaaggcacagttaactgagaactgactagtacagctaaaaccttttctttttcactttactttggcttactgatttgtaacgtagatgttagccctggatttgcaaaacggaacggaatctgtaaactgatactgcttgagtcgaatcgatcgaagtgattctgcacc

SEQ ID NO: 8709 - DNA, 2068 bp, Zea mays
aattcccttccgcctctcctcccgtcctctcgcaagcccacaccacacctgcagaaatcacagcggcaggtgcagcaaaaatctccatgcccccgctcggctagatctccgacgagccggccccgcgcggtagcagattcgctcccctatcccgaccgatgggcggtgaggtgccggagccgcgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccccgcgccgccatgtacgggctcatccccgaagactttggcgcctacgcggcgccctgggtcgccgagctcgccgcgccccttgactgcctcaaggcgctccacctgcgccgcatgaccgtcaccgacgaggacatcgccgtgctcgtccgcgcgcgcggccacatgctacaggtgctcaagctcgacaagtgctccggcttctcaacagacgccctctgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgt

SEQ ID NO: 8710 - DNA, 2067 bp, Zea mays
attcccttccgcctctcctcccgtcctctcgcaagcccacaccacacctgcagaaatcacagcggcaggtgcagcaaaaatctccatgcccccgctcggctagatctccgacgagccggccccgcgcggtagcagattcgctcccctatcccgaccgatgggcggtgaggtgccggagccgcgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccccgcgccgccatgtacgggctcatccccgaagactttggcgcctacgcggcgccctgggtcgccgagctcgccgcgccccttgactgcctcaaggcgctccacctgcgccgcatgaccgtcaccgacgaggacatcgccgtgctcgtccgcgcgcgcggccacatgctacaggtgctcaagctcgacaagtgctccggcttctcaacagacgccctctgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgt

SEQ ID NO: 8711 - DNA, 1168 bp, Zea mays
accaattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaagttgtccctcaccagggcggtgttttacatcatcatgcagtgcctgggcgccatctgcggcgcgggcgtcgtcaaggggttccagcaggggctgtacatgggcaacggcggcggcgccaacgtcgtggcgcccggctacaccaagggcgacggcctaggcgccgagatcgtcggcaccttcatcctcgtctacaccgtcttctccgccaccgacgccaagaggaacgccagggactcccatgtgccgatcctcgcccctcttccaatcgggtttgccgtgttcctcgtccacctggccaccatccctatcaccggcaccggcatcaaccccgcgcggagccttggcgccgccgtaatttacaaccagcaccatgcgtgggctgaccactggatcttctgggtcggccccttcatcggcgctgcgctggctgccatctaccaccaggtgatcatcagggcgatcccgttcaagagtaggtcttaaaggagccgatgctgctgcttcgagatgctgccggtcttgaaaggatggattcgtggctgtttcaaatgatcccctactatgttacgtggagttccattcctctttcaaagttcggagctgcttttatccgaacccagacttgtaattcatctgtaccaattgtgtaatatgccgcgcctctgttatgtgcaattcaaaattatgagacagcgagtcaagctttaagagttcatcc

SEQ ID NO: 8712 - DNA, 2182 bp, Zea mays
caataattcccttccgcctctcctcccgtcctctcgcaagcccacaccacacctgcagaaatcacagcggcaggtgcagcaaaaatctccatgcccccgctcggctagatctccgacgagccggccccgcgcggtagcagattcgctcccctatcccgaccgatgggcggtgaggtgccggagccgcgccggctgagccgcgcgctcagcttcggctgcggcggcgtccccgaggaggcgctgcacctcgtgttcggctacatggacgacccgcgagaccgggaggcggcctcgctcgtgtgccgcctctggcaccgcatcgacgcgctctcgcgcaagcacgtcaccgtgggcttctgctacgccgtggagcccgcgcggctgctcgccaggttcccgcggctcgagtcgctcgcgctcaaggggaggccccgcgccgccatgtacgggctcatccccgaagactttggcgcctacgcggcgccctgggtcgccgagctcgccgcgccccttgactgcctcaaggcgctccacctgcgccgcatgaccgtcaccgacgaggacatcgccgtgctcgtccgcgcgcgcggccacatgctacaggtgctcaagctcgacaagtgctccggcttctcaacagacgccctctgcctcgtcgcgcgctcctgcaggtctctgagaaccttgttcctggaagaatgtataattgaggatgaagggagtgaatggctccatgaactcgctgtcaacaattctgttctggtgacactgaacttttacatgacagaactcaaagtggagcctgctgatctggagcttcttgcaaagaactgtaaatcattgatttctttgaagatgggtgactgtgatctttcagatctgattgggtttttccaaacctccaaagcattgcaagaattcgccggtggtgccttttttgaagttggagagtacaccaagtacgaaaaggtcattttcccacctaggctatgcttcttagggggtcttaccttcatgggtaaaaacgagatgccagttatctttccgtattccacaatgcttaagaaactggacttgcagttcactttcctcaccactgaagaccactgtcagcttattgctaaatgccccaacctaagtgttctcgaggtgaggaatgtgattggggatagaggactagaagttgttgctgctacatgcaagaagctacgaaggctcagaattgagcgtggcgacgatgatcctggccaagaagagcagggaggagtctctcagataggtttgacagccgtagccgttggctgccgcgaactagagtacatagctgcctatgtatctgatatcacaaatggggcgctggaatccattggcactttctgcaagaatctctatgatttccggcttgttctacttgacaaacagaagaagataacagacctgccacttgacaacggcgtccgtgccctactgaggaactgcgtcaaacttcggaggtttgccttctacctgagaccgggagggctttcagacgtaggcctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtattactcccttgctggaaggaggccggactgccctcagtggctggtgactttgcaccctgcgtcactgtaaatacgtcaagctgtcccgagtgtggtttttgtaccagctgcttgtgtaccgtaataaactctagtactgtagtggtggaggcgtagtgcaataaagttgcagttgttgcttgtactagtgaatctaatcctaggaggttgttgccctgtgctttcttttccccggaattgtatctttgctccactgtaaatatcagaaatggcctgtgctagatgagttgaat

SEQ ID NO: 8713 - DNA, 2072 bp, Zea mays
tcgctcgttttggaattaactttatgctaacagaatctaggtgtcattaagctagattaagcttgctgcttgacttagtagtgtaaatctgtaaagaaaattacctggtttgggtttagtctctataaaagaaatggaacagaggaatgttctggcattgggtgaacatgttctaaaagctactgtttggaagcggaagcataagactgctatggagcaccctgaaggcaatgatgtgatggtgttctctcagcatgatcaaagaaagcaccctgtgatatttgacgacagagctaaatgtaagaagtctaaattaatttcctgtgggagtggagttatattggagtcatattggaactttaagacaagtgggctgcctgtgcgcgtgcttttctaccaacatggtgactggagtgattttccagaggatgttgtaaatctagcacaacaggacttccagttgaagaagccaattacaactgctgtgttccagaacaagcacatcctgttggacttcattcacatgatttgcatagattatgagatgaccatagacaaaccactagcatgggttgatgataatggcaaacgcttctttccagatttatctgctgggctctacacatctaaaccatctcagcatgagaatggtgaagctgatgagtgtgatggaacgcctacaagtgtagctgaaagttctagttcggtatctgttggtgaagtagtttctcatggtaagaggatcaatgatattgcagaggacaacatgagagcacataacatattgtatgaagctgttggtgaaaatatttcaggtccttcattccatttgaatgaatattctagtggaaccatacaagctactggcaagccaaacgattgtcgacgtattgattcagctgtgcggaatttgttgctcaaaggattaggtcagccgtttagtgaggaagatattattggtatctatagaacaccactgctagatcagcgagggcaagttcgttgtggtctcttccagaaggagatcgaagagaccaggagtcgtcgggggaatgcaaatgtacgttatgcttggcttccttgctcaagatataccatggagcagatggcaatgcggggtgctctggaaatcgcgaagcctcataaggggtccatttgtggtgttgggacttgtcttgctcctgcaaactgtacaaattcatgtgccagatattctgattttcatgaagatggcatcatcagaatgatgttgtgccgtgtaataatgggtaatgttgaggttgttttgcctggatcaaagcaatttcagccatccaatggaagttttgataatggtgtggatgatcttcaaaatccacagaattacatcgtatgggatgctaatgtgcataaacacatatatgctgaatatgctgttattgtccaagcacctctcgtgaccaatgaatgttcgggcttgaaggatagcgtgcccaacatatctgagatcataagttctggttctcgagacaatctaaccaaggaggataggttcgcgccttgtggtgtcgaacaagaagcacctaggctggggcgtgctccaagggccccctcctcaccatggatgcccttttcgatgctttttgctgctatttccacgaaagtgcctcgttcggacatggagttggtcatcagatactatgaagaattcaagaggaagaggatgagccggagcgacctggtggtacggatgaggcaaatagtcggtgataagatattggtttctacaataatgaggcttcaccaccagaagaagcccccatcgatggcagcagcagcagctgggctagcaagagcactcgcaaggggggaagagggagggggagtagccgagtaagattagtttaagccgccttgtcttttgagaaatttatggagcacatatgctttgtcgacatggccagacccaaggtgtcaaaagggagggagatgagctgagcaactgttgtagtgtagtctcaaactcaaagcgtttaggtcttgacatttgacaaactaaaactcagaaacattatcatgagtagtgttttttt

SEQ ID NO: 8714 - DNA, 1431 bp, Zea mays
attcgggcgcgtgatccggtcggatcttgctttcccggggggcgatcgaggccacgccgctgctgccgcggtgccctccctctgggctctggcctctgcgtgtgacgtgccgtgccatggcgctcgccctcgcctatatcccccgcctccctcgccccgccgctggccgccgcattcagtaaaaagccacctaccctaccctcctgcgctggtactacttactacttagccaggccaaggagcccaacgagggggaacgctgcggtaggcgcgcgctgctcgtcccaccccacgccgccatgacggtgccggatgccgagtcgcgcttccatgtcctcgcggtggacgacagcctcgtcgacaggaaactcatcgagatgctgctcaagacctcgtcctaccaagtgaccacggtggattccgggagcaaggcgctggagctgctggggctgagggacgcgtcgtcgccatctccgtcctcgcctgaccaccaggagatcgacgtgaatctcatcatcactgactactgcatgccaggcatgacaggatacgatctgctcaagagagtgaaggggtcctcctcgctcaaggacattcctgtggtgatcatgtcgtctgagaatgtgcctgcccggatcagcaggtgcttgcaagacggcgcggaggagttcttcctgaagcccgtgaagctggccgacatgaagaagctcaagtcgcacctgctgaaacggaagcagcccaaggaggcgcaggcgcaggcgcagcagggacaggcggtggagctggagcctgagcagcagctggacccgcgcgcgcagccggcgcacgacgcggaggaaaccgcggcagagccgccgccggccgcatccaacggaaccgccgacggcggcaacaagaggaaggcggcggccatggaggaggaggggatgctggccgtgatgacggtggcggcgccggagagcagcaccaagccgaggctgtccaccaccagcaacagcctggcggtggagacctgagctgagaatcggacggcgaccggatcacatactactacctacgtacattaatccaccattgcgggcagtcgagaaccaaccgaccaaacccaggccaccgccgagaaagagctcgtcctccttttctttcgctggttcttttggttctcggagctaattaatggaatgaaggtgtgagctcctggggatggaggggcggttaccggctctaagtgaagaacaattacgacgtaccttacctagcggctgctgcttcggccggcaaattttgttgtgctcgtggtcatggacacccttgtgttcgttaggagggggtcggggtggaacggtgaaaaggaagctgtagatagaaaaggcaggcgtctcatgctcttattgtctagtctaatttttaattttactcggcttattaatc

SEQ ID NO: 8715 - DNA, 1713 bp, Zea mays
cgtcgcggcccgcttcccccccggccaagggatggacgcgcttcgcctacggccgtccctcctccccgtgcggcccggcgcggcccgcccgcgagatcattttctaccaccatgttgttccatacaacgaaatggtgaaggacgaatttgcttttctagccaaaggacccaaggtcctaccttgcatcaccatcagaaattcttcgaatggaaatcctcctattgtaggatatcacatcggtcattaaatacttctgttaatgcttcggggcaacagctgcagtctgaacctgaaacacatgattctacaaccatctggagggcaatatcatcttctctagatgcattttacagattttcccggccacatactgtcataggaacagcattaagcatagtctcagtttcccttctagctgtccagagcttgtctgatatatcacctttgttcctcactggtttgctggaggcagtggtagctgcccttttcatgaatatctatattgttggactgaaccagttattcgacattgagatagacaaggttaacaagccaactcttccattggcatctggggaatacacccttgcaactggggttgcaatagtttcggtctttgccgctatgagctttggccttggatgggctgttggatcacaacctctgttttgggctcttttcataagctttgttcttgggactgcatattcaatcaatctgccgtaccttcgatggaagagatttgctgttgttgcagcactgtgcatattagcagttcgtgcagtgattgttcagctggccttttttctccacattcagacttttgttttcaggagaccggcagtgttttctaggccattattatttgcaactggatttatgacgttcttctctgttgtaatagcactattcaaggatatacctgacatcgaaggggaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggtaccccacgctgcttgatgatatcccatgtgtccgggtgaccggacctgatcgtctctagagagattggttgcacaacgtccaacatagcccgtaggtattgctaccactgctagtatgatactccttcctagtccttgccagcaccagtgacccaaacttggtcggctgagctcagcgctcagcagctttacgtgcatctgcgccttgacttgtgcagtgggcgtcgctagcatgaatgatgtatggtgcgtcacggcctgacggttcgtcagtctgggccgtgttttgtgtc

SEQ ID NO: 8716 - DNA, 1690 bp, Zea mays
tcgtcctcctccgtcgggccggaggagcgtctctttgtcggcgcagcgtgcagagcaccgcagattcagagacacgatgatgtcgcgacagtgtgcaaaccgcatctttcttaccggaggttccagcttcctccatggcctcaaatctagagttgcatccagtaggagtcacggcaccgtcagactcaactggcgctgcgtgagaactaatctctggagggccgagcgccttggtgtcaaggctactccgtctgagcatatcattgcagtactgcaagcgtcagatattttcagtggcatcaggaaatggagcaagttgcaattggtcgccatgacaggggtgatggcatgtgtagttctggtagtcccttcttctgatgcagtcgatgctctcaagacatgcacttgcctgctaaaggaatgcagaatagagctggctaaatgcatagcgaacccatcctgtgcagcaaacgtagcatgcttgaacacgtgcaacaatcgacctgatgaaactgaatgtcagataaaatgcggagacctgtttgagaacagtgtagtcgatgaattcaatgattgtgctgtttcacgcaagaaatgtgttccaaaaaaatccgacgtcggcgagttccccgtccccgatccatcttcgctggttaagagcttcaacatggcagattttaatggcaaatggtacatttcaagtggcttaaacccgacgtttgacacattcgattgtcagcttcacgagtttcatgtcgagggagacaaattgatcgcgaacatcacatggagagtccgcaccccagactctggcttctttaccaggtcaaccgtgcagcgttttgtgcaggacccatcgcagcccggcatactctacaaccatgacaatgagttcctgcactatcaagatgactggtacattatctcatccaaggttgagaacaaggatgacgactacatatttgtgtactatcgtgggcgaaatgacgcatgggatggttatggtggttctgtattgtacacaagaagtaaaactgtacctgaaacaataataccggagctggaaagagctgcaaagagcgtaggtcgggacttctcgacgttcatcatgaccgacaacacctgtggtcctgagcctcctcttgtggagagaatcgagaaaactgtggtggaaggagagaagaccatcgtcagggaggtgaaggagatcgaggaggaggttgaggagctggagaaggaggaggcgtcactgtttcagaagctggcagaaggtctcatggaggtgaaacaggatttcatgaacttcttgcaggggctgagcaaggaggagatggagctgttggatcagctcaacatggaagcgactgaagttgagcaagtcttcagccgtgcactaccgttgaggaagctaaggtagctgcagagcaaaggacttggagaaaacaagccatcaagtactggccgaaacggattctatttgccacagcagtacccacagtagagattgttgaacagatacaacaaacatttttaattttcttttctttttcttttcttttcttttcttttctttgtttacccttttctgtggtcaaaacacatgcctacgttagccctatttgtaaagcatcaagagacaacgtaactttttcttgccaaacagagaaaaaaaacaagtgtacttaagact

SEQ ID NO: 8717 - DNA, 1189 bp, Zea mays
ctgtatgcttgtggaaatgggcagcagagcagctttcgtggtcgcgtttctcctgagggctatatatgcaggcacgcagatactcaccaaggctgccttcgatgaaggcatgaacacgtcggtctttgttttctacaggcatctgactggtatcctcttcttggtgcctattgcttttgtgcttgagaggaaaactgcccctccactgtcattcagagtctctctgaaattgtttttccatgcactatacgggatctctggagcaataaacatatacggcctcggtctcagctattcttcagcaacatcatcgtctgcgatatttaacctcctgccagctgtggctttctttctggctgttcttttggggatggagacactgaacttgaagcggttccacgggatcgcaaaggctgcaggcgtgttgttcagcactgctggcgtgactgtgctggcgttctaccaaggccccgcattcagatcgttcatccaccacaccgctttctcccatcacaacgtccacgctggggtcgttaccgccgctcatcctaaaagcgtctggatactggggattttcctgacgaccttgtcgactgcatcgtgggctctctggacggttcttcaggggccaatgctggaagcgtacccatccaagctgctcaacacgaccctccagatgatcttcgcgacggtccagtgcttcttcatcgccctagcggccgagagggacttgtcgaggtggaagctggcgctggacatacgcctttacgctgtgatctactctggaatacttgtctcgggagtcgcttactacatgcaagtatgggtgatcgagaagagcgggcctgtcttcttggccatgacgatgccgataaccttgcttgtcaccatcattctgtccctgtttctcggagagccggttaccctgggaagcatcttgggtggactgatcatggtcggtggtctgtacagtgtgctctgggccaagaggtctgagcaggtgcatgccagcaagcagcaaatggcagcgcctactcctcctccagcaggcgacacaagtgtaggccgagcttagcttgtttattttgcagtgactgagatcgagagaactgtgaagttctgtttttagataatggaaacctgaatgagcacatgcatcaggcccctaaggactctcctaacagctgct

SEQ ID NO: 8718 - DNA, 1376 bp, Zea mays
cttgcaggttgcagccgatgagaatcgagcgtgatctccacatggccacaggggacggagaaactagctacacgaaaaattctaggattcaagagaaaactatgtttcagatcaagcctgtccttgaggaggccacaagagcagtatacacagctctccaccctcaaaccatggttgttgctgacttaggctgctcatctgggcctaacacactacgcttcgtatccgaggtgattggcatcatagctcgccattgcaaagaatatggccgacaacatgaccacacacagcttcagttcttcctgaatgacctgcccggaaacgacttcaacaatctcttccagctgatccagcagttcaataagtcgacggcaataaaccacaagagtgaggcagctgaggcactacctcctccgtgctatatctctgggttgcctggctcctactacactaggatcttccctagcgaaagtgttcaccttttccattctttgttctgccttcagtggcgctctgaggcaccagagggcaacaaaaaaacatgcctagatatctacatcacaaagactatgtcaccgtcgatggtgaagttgtttcaacaacagtttcagaaggatttctccctcttcctcaggctacgctacgaggaactcgtgtccggtggccaaatggttctaacatttattggaaggaagcatgagaatgtgttcactggagagtctaaccatctttacggattgcttgcgcagtcactgaaatccctagttgatgagggtcttgtggagaaggaaaaacttgaatcattctatttaccaatgtattcaccatcggttggtgaagtggaggccatactaaagcaagttgggttgttcaacatgaatcatgtaaaagtattccagacaaattgggatccctacgatgacttggaaagtgatgttgtgcataacagtattaggagcggtgaaaatgttgctaagtgcctacgagcagttatgcagccgctagtcgcaagccaatttggagaacccattctcgataagttattcaaagagtacgctcgccgtgttgccaaacaccttgagaatgagaaaaccaagcatgctattattgtcctatccatcgagaaagcaattcacctgtgaagtgtattgtttctcactatctcgcttggcatgctactatttgtgtagaaaactttgtatgtatgtttttttgtgtgtttgtgtcactagtgtattgaattacatatggtgtttttgttgttttatttatcacttctcctgtattcctatattttatatgtctaagtttttaaggtgatttcatgcaacccttgtacaagcaattgatacaaataaattgcaccttttatgatc

SEQ ID NO: 8719 - DNA, 1939 bp, Zea mays
acgcccacacagcagcatcaacctcgggtgctctgcggccactggactgccctgccagtgctcggtgcccgtgcccgcgcgcgctagcctagctgctcctgcctggttcgccgtagcccgtagcccgtagcacaacaacaacaaaaaaaatctccgcggcgcggggggaggtggtctgttcaccttggggagcagcggcgggccgtcggccgagaaatgcccggtggcgccttcctcctcaacggcagcggcggcggcatggcggactacggcggcggcctcaccgtccccgtcgtcgtgacctgcctcatggcggcctccggcggcctcatcttcggctacgacattggcatctcaggaggtgtgtcggagatggaggatttcctgaacaagttcttccccgggttgctcaagaggacggcgcgcgccaacaaggacgtgtactgcatttacaacaaccaggcgctgacggccttcacgtcgtcgctgtacgcgttcggcatggtggggacgctgctggcgagccgcgtgacccggcggctggggcggcaggccgtcatgctgatcggcggcggcctgttcttggccggcgccctcgtcaacgccgccgcggccaacatcgccatgctcatcgtcgggaggatgctgctcggcctggggctcggcttctccggccaggccacgccggtgtacctcgccgaggtgtcgcccccgcgctggcgcggcggcttcatctcggccttccccctcttcatcagcgtcgggtacctggtggccaacctcatcaactacggcacctcgcggatcccgggctggggctggcgcctctcgctcggcctcgcctccgtcccggccgccgtcatggtggtcggcgccgcgttcatcccggacacccccagcagcctcgtcctgcgcgggaagcacgacgacgcccgcgccgcgctccagcgggtgcgcggcaagggcgtggacatcggccccgagttcgcggacatcctcgccgcggcggagaacgaccgccggaacgaggagggcgcgttccgccggatcctgcgccgggagtaccggccctacctggtgatggccgtggcgttcccggtgttcctcaacctcacaggggtggccgtcaccgccttcttctcgccgatactgttccggaccgtcggcttcgagagcgacgccgcgctcatgggcgccgtcatcctgggcctcatgaacatcggcggcatcctcgcgtcgggcttcgccatggaccgctacggccggaagctgctcttcatgatcggtggcgcgctcatgttcacgtgccaggtggcgatggcgagcataatcggatcacacctcggcaacgggagcaagatgcccaaggggtacgcggtgacggtgctggtggtggcgctgatcttctcggcgagcttcagctggtcgtggggcgcgctgtactggaccatccccggcgagatataccccgtggaggtgcggtcggcggggcagggcgcggccgtggcgctcaacctggggctcaacttcttgcaggcgcagttcttcctggccatgctgtgctgcttcaagtacggcaccttcctcttctacgcgtcgtggctggttgtcatgaccgccttcgccgtggcgttcgtgccggagaccaagggcgtgccgctcgagtccatggctcacgtcttcgcgcgccactggtactggggcaggttcgtcaaggaccaccagaagttgggcgaagagtccacctagctaagctaataattcggaatcagcgaacgacgtaccctactaccagtagcagattattgataagggagtcaaacacatattgcgtgtgtgtgtcttttaaagtgttcgtttagaatggcttgagaagctcatccgtgtagtaaatttggagacttcgaaatataataaatatgttcgtagttggcaagct

SEQ ID NO: 8720 - DNA, 2829 bp, Zea mays
aaagcacctccgactcggagtcgcggcgagagccgagaaccttctcattcatcttcctcttctatccatcctgcctgcctgcttgcctccgtattccagctagatctccgggcagccgattgaccgagaagtttgtggttgtggcggcggcggagagggaaacggggagcgggagggcggcgcggatgccactgctgcgccggcgccggcggggccggtgatgcccgccgtggcggtcgcttgaggccgccgtgcgtgggaggtggacgggggagcgaggcggtgcggaccgaggttgcgttgggttggattcgattgggctgcgtctgctgagaaggtctaggaggagctatgaggtactacttccgtcaggtccagcgtttggttggagatatggaaggaggagctctcttgtttatagatgacctcaactccaagtgacaaagtgaacagctgttgaacttcccgtctatttctgtttctttttgctggatttggagatggaggtgaattcctctggtgaggaaacggtgataaaggtaaggaagccatacacaataaccaagcagcgggagcggtggacagaggctgagcacaaacggttccttgaagccttgaaactttatggcagagcatggcagcgcatagaagagcatgttgggacaaagacggccgtgcagatcagaagtcacgctcaaaagttcttcaccaagttggaaaaggaagctattaacaatggtacttctccggggcaagcccatgacattgacataccgccaccacggcctaaaagaaaggctaacagtccatatcctcgaaaaagtggtctcagctctgagacaccaaccaaagaacttccaagtgacaagtcaacaaaaccaaatatgcccttgagcaatgagaatgtactaatggcaggtgatgcatctcttcagaaatttcaaaggaaggagttgtctggaaaagaaagttgctcggaagttcttaatctcttccgtgatgccccatctccatcattttcttcagttaacaaaagctcttcaaatcatggtgcaccgattgaggcaagtaaaacaaaaatccgagatatgaccattatggaaaatagttctcttaaccccaacatgcaagaggatgtaaaggaaatcaatgatcaggagatggaaaggcttaatggtacccaaatcagctctaaatgtgaacactctcatgagggatatttggacatctcaatgcaacaaatgaagctaaagccagagtctgtggagacaacatatgtggacaaacaaaccgcaagagcttcacactccctagcggagagaactgggacaactagcattccggtcactgcaactgaagaaactcattctgttctaacaagtgatcaagtgggaatcaatggaagcatgaacccatccatccatccaatgtttcctgcagatccaaaatttgatagcagtgccacaccacagccttttcctcataattatgctgcctttgctccaatgatgcagtgcaactgcaaccaagatacccacagatcattggtcaacatgtcatccaccttctccagcatgcttgtttccacgttgttgtcaaaccctgccatccatgcagctgccaggctcgcagcatcatactggccagcagctgaaggtaacactccgattgatccgaatcaagaaaatcttgcagatggtgttcaaggaaggagcatagggtctcctccaagcatggcttctattgtagcagctacagttgctgcagcatctgcatggtgggcaacacaaggtcttctccctttcttcgccccacccatggctttttcatttgtgccagctcccagtgctgccttccccacagttgatgttccacgaccttcagagaaagatagagattgcccagctgaaaatgcacagaaggaatgccaagaagctcgaaaacagggacagtttgaaggtttcagagttgccgcttcttcagagtatgatgggagtggaaaaggcgaggtgtctgtccacacagagttaaagatatctcctgtccagaatgctgatgccacgtctgccgcaggagctgacacgactgatgcattcatgaataagaaaaagcaggaccgctcttcatgcggttctaacacaccttcaagtagtgatgtagatgtggacaatgtccctgagaaagagggcaatggtaatgagaaggcgaagcaagcctcctgcagcaactcttcagctggtgacactaaccaccgcagatttagaagcagtggaagcacgagtgattcatggaaggaagtttccgaagagggtcgtctggctttccatgcgctgttcagtagagaaaagcttccgcaaagcttttctcccccacaagcagaaggctcgaaggaagttggcaaggaggaggaagatgaagtcaccacagtggcagttgacctcaacaagagtaccacaagcattgatcatgacctcgacacaattggtgagccaagggcttcctttcccaatgaactgtcgcccctgaagctgaaattgcgccgaacaggcttcaaaccatacaagagatgttctgtggaagcgaaggagaatagggtgccggctagcgacgaggttggtaccaagaggattcgtcttgatagtgaagcatcaacatgagcgatttctacatggttaccgctcggacttcctctgccgccatgaagtttatgacaaagttgtatttacatctaaactagtataggacttaaagaccttgcaatgcaatgcttcatgaaactgttgtgtgctgtattttagtacttgtgaagcagcccggtagactgctttt

SEQ ID NO: 8721 - DNA, 1214 bp, Zea mays
cttcttgatccgcacaggaaggtggaaggtcccggcagaagaacttggcgggcgaaaggcgaaaccgacgtgctcccgggcgggcggcgacagcggcatggagcgagagcggcaggcagtggcgaggaacaggaaggtggtgctgcgcgggtacatcgaccgcgcgcccagggaggaagacatggagctcgtcgacggcggcgccgtggagctgcgcgtccccgagggcggcggcggccccgcggtgctggtgaagaacctctacctatcctgcgacccttacatgcgcggcaggatgcgggacttccgcaactcctacatcccgcccttcaaacctggatcacctattgaagggtttggcgtggggagggtggtcgactccactcatccaggattcagtgccggtgacgttgtttccgggatgactggatgggaggactacagtctgatcaccaatcctgaacagctcaggaagatccagcaaagcgacataccactctcctatcatctgggccttcttggcatgcctggctttacagcttatgttggattctatgagatctgttcaccaaagaaaggggagtttgtttttgtttctgctgcatcgggagcagttgggcaaattgttggtcaacttgcgaagctccatggttgctatgttgttggaagcgctgggacagatcagaaggttgagctcttaaaggaaaaattcggatttgatgcggctttcaattataaggaagagcctgacttgactgctgccctgaaaaggcacttccctgaaggcatagacatctacttcgagaacgtaggcgggccgatgcttgatgctgtactactcaacatgcgagtacatggccgcattgcggtgtgtggcatggtttcccagcacggggtgactgcccctgccgggatccacaacctgttctccttgataagcaagaggatagcgatgaaggggttcatccagagcgattacgtgcacctgttcccgcagttcgtcgatgacatcaccaggcattacagagacgggaagatcgtgtatgtggaagacatgagcgttgggctggagagtgggccggcttccttcgtcggtctgttcagcggtaaaaatgttggcaagcaggtcgtctgtgtgtcgcgggattgaaaggcctggattttgttccctactggccagtacccttaaataaaatcaggaaaacattattttc

SEQ ID NO: 8722 - DNA, 1781 bp, Zea mays
cgaagctacccctgttcctctgcgatttgggctcgtcctgtgtccttcctgttgctcaaaagctcgctcattcgatgtccctgtctgaaaggcgacaaatcccactggaattcggagcacagagctttgaatccaggggccaaaactttttgctcatctcccttgcggaaaagcgcctcctctgcgtctgaaagtcggatcttttttcacagattcgatttgaagttcccgagcagctcgaggaccgcggtgtcggtaagacttgctttgaagatcttgatcaccacaagagatttgctgaatttccggtcactgtactttttccactggacatgtcctttcgcagcatagtccgtgatgttagggaaagctttggtagcttatcaagacggagccttgaggtcaggatttctggtttgcctggtctgtctggtggtcatcatagagggaaatctgttggatctgtgagtgacctgcgcgacagacctgtagtagttgatcaaagcaggtgggttggtcttcctcctgaattgcttcgagatgtaatgagaaggcttgaggaaggtgagagcaattggccatcccggaaaaatgttgttgcctgtgcagccgtctgtggaacatggagagagatatgcaaggatatagtgctgagcccggagttctgcgggaagctcacttttccagtatcacttaaacagccgggaccaagaaatggaataatccagtgtttcataaaaagggacaaatcgacatcaacttattatctttacctatgtcttagccctgttgtcctcagcgaggatgggaagtttctgctagcagctaagaggaatcgccgtacaacatatactgagtacatcatttctgtggatcctaaaagtatatcacgatcaagtgatggctgtgttggaaaaatgaggtcaaattttcttggcactaaattcatcgtgcatgacactcgagcaccacacaatgctgggagccttgtctcctgtgagcgcggcagccgcagaatctcctctaggagggtttcccccaaggtacccactgccagctaccccattgcccgggtgaactatgagctaaacctgcttggcacaagggggcccaggcgtatgaattgcacgatgcattccatcccagcctcaacgctggaccctcaaggcatggtgcctgagcctggccaacccaagcagatcttcgtccctggctcgtcgtccttcgaagattcctttcgcagtgcaaacaacaccccttccagctcaaggttctcggtcgcagaccgctccttggattggagctcctctcgattctcagagacgagcggattggctcagcaggacgacgatgacagtgaccaggctaaggagaggcctttggttctctgcaacaaggagccaaggtggcacgagcagctgcagtgttggtgcctcaacttccatggtcgggtgaccgtggcttctgtgaagaacttccagttgatagctgcaccacaactagattctgaaccgtcacagcaagctcagcagcaaacccagccttcgaattcgtcttcagcatcggatcatgacaaagtgatcctgcagtttggtaaggtcgccaatgacatgttcactatggactaccgatacccactctcggcattccaggccttcgccatctgtttgaccagcttcgacagcaagctggcttgtgaataaattgtacataaagaacaggaatacatgtagattgtatctctgcagtaagtatttacagtgtgtgtgctggtgtagttt

SEQ ID NO: 8723 - DNA, 1060 bp, Zea mays
ttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagagtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggac

SEQ ID NO: 8724 - DNA, 963 bp, Zea mays
tactcccgccgccttcgcctaaagaggcctcgcccttaccctctccggcgaaaaccgattcccttccccgattccctccggcgtttcctggtcccatagtgcaagcaaggacaccgctcctctagcgagctctgttctgaagcggcaagaaagatgattaatcttttcaaaataaagggtcaaaggaaagaagaggcagcaagtgctgctggaaaggcccctgttaagaaacagtctgctggggagctccgtcttcataaagatattagtgagctcaacctgccgaagaccacatcaatttcttttcccaatggcaaggatgatctgatgaattttgagaccaccatccgacctgatgaaggatattacatgggaggcactttcgttttcacctttcaagtgtccccatcttatcctcatgatcctccgaaggtcaaatgcaagaccaaggtgtaccatccaaatattgatctggaaggcaatgtctgtctgaacattctgcgcgaagattggaagcctgttctcaacatcaacactgttatttatggcctgaatcttctttttacgcaaccaaacgacgaggatcctctgaaccacgaagctgcagttgtccttcgtgacaatccaaagatgtttgaggcaaatgtgagaagagccatggctggaggctacgtcggccaacactatttccaaagatgtgcttgacttgatgtggtggtggcttgaaaacgatcaacagagcccctctccctgtatcagcaccagcgcgcccagctttgtgtgcggaaagtgcttctggaagcaaaatccaaaccgttcatggtgtgatactgtgatgcatctgtttgcccgcctttgtgatgtgtggtatagtggtggtgcataatgacagggaaatgcttctctaactgtatcattcgttccataaatcctaaacgaggaatgggaagtggattgttaagc

SEQ ID NO: 8725 - DNA, 1388 bp, Zea mays
agaagaagaaaaaggagaggcccgcgactgtagtgggattgtgggaagatgcctcgggatggtgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccaccggcggagtccggcaagatcaccttcccctcctcgctcaagcagccaggtccaagggagagaccaatgcagtgctttatcaagaggaataagaacaactctacattctacctctaccttggcttcacaagctcacctgtggataaagggaagtttctcatggctgctagaagatttaggcgtggtccccatactgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattacgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatgaacttttgctctagttccatgcaaaagacatttcaatgtacatctgttcatggtgaagtgatacttctcccttttct

SEQ ID NO: 8726 - DNA, 1586 bp, Zea mays
cgtctctactcctcttcctcctctctctactctccaagttctcttctccgtcgaccgctctacacgtctcttgtcgatctggacaccgaggtggaagaaggaagcagtcagcagatggatccatggatcagcagccagccttctctgagccttgacctgcgcgtcggcctgccgccgcttagcctccaccaccaggcgccggtggccgtcgccttgcccaggtccaagctgctcgtcgaggagaacttcctcctgccgcctccaaagaaagaaccagaggtcgcggctctcgagacggagctgcagcggatgggcgaggagaaccggcgcctggcggaggcgctggccgaggtggcctccaagtacgaggcgctgcgggggcagtacacggagatggtggccgcggcggccacggcctgcgggaaccacccgtcgtccacgtcggagggcgggtccgtgtcgccgtcgcggaagcgcaagagcgagagcacggacaccgcgccgcccgcgcagcagctactgcaccagcactacccggcggtggcgccggaccagacggagtgcacctcgggcgagccgtgcaagcgcatccgggaggcggagtgcaagcccagggtgtcgaagctgcacgtgcacgccgacccggccgacctcagcctggtggtcaaggacgggtaccagtggcgcaagtacgggcagaaggtcaccaaggacaacccctgcccgcgggcctacttccgctgctccttcgccccggcctgcccagtcaagaagaaggtgcagcgcagcgccgacgaccccaacatcctggtcgccacgtacgagggcgaccacaaccacggccagcccccgccacaggcgcaggcgccgcacgacggctccagccctggcgccagcaagaagccgccgtcgccgccgaggccggtcgccgccgctccggcgccgctccaccaccagcaggtccagcagcaccagcagcagcaggcggttggcgcggtgaaatgcgagccgcccgtggccgcggcggcgtcggagctcatccggcggaacctcgcggagcagatggccatgacgctgacgcgggaccccagcttcaaggcggcgttcgtcaccgcgctgtccggccggctcttcgagatgtcgccgaccaaggactgacggaacggatcggatggattgggcgattggcatcgcaggagattctggatcagattgtcttcgagcgcacgccgcaatggtcaactgcgcagcgctggcttggctgctgcctccgttcactcttcgctgtcagagcgaaacagcggtaacagagcaagacacgaggggtctgcactctgcagttgtgcaggaggaggaacagacacagggagaggagggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttagttgttagctgtaggcgaaactgttcatccaattgatcaaatgaaaattatttttccct

SEQ ID NO: 8727 - DNA, 1889 bp, Zea mays
aatttcatccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtcggccgccgcccacatgccttcctcgtcctcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggcagttgctcttgccagagcagctgccgaagctgcccaagaagttgttcagatagtacaaagaaacaaccatcagccggtaattagaccaaaaaagtgtgtggacaactacttggcaaatgaaatccttcgcacagagatgcgatcgagcagtcctgacatgtatgctaataatcctttgatggagtatctggactcttatggtatcatggatgctgaagatgaattagatgcttatgcgcagtatactgagaacatagctgtgaaatctgctcgtcaatctgagagaaaagctaggagaactagagcagcaataaaagctagcacaaccctccatgcttcacaaaaggttgcattatcctcaaagaagaagcggtccaagggttcctcgtctagtatgaatcctttaggttcgttgtggaagatgaccggtaggagacttcttacagccaaggaagaggttgaattctcagaaggatcttttgaagcttgaggcgatccaagctgagcttatagagtacaatggcggtcagccaaccttctcgcagtgggcaacagcagctggagttgatgagaaaactttgcgcaagcgcttgaattatggtatttattgcaagaacagaatggtaacatctaatgtgagacttgtaatctctatcgccagagagtttgaaggccctggaatggacttttatgatcttattcaggaaggaatgcagggccttataaggggagctgaaaaatttgattcatcaaaaggttttaggttctctacgtattctcactggtggatcaaacaagcaatgcgtaaatctgtctcggaacaatcccaaatatttcgcttgcctgctcacatggttgaagcaagctaccgtgtaaaggagtgtacaaaacgacttcgccgtaagcttagaagacgacccaccaatgaagaaattgcagtggacactggtattccaattaaacgagttgaggcagcagtaaacctcccaaaatatagtgtgtcccttgatagcaaaattggttccaccgacatgacatatcaggaggtcacagctgatcccagtgctgagacagctgaagagatgctcaacagaatgtccatgaagaaggacgtacacatggcactagatactctcaccacacgcgagaagcaagttgttgttctgaggtttgggctcgaggatggtcggataagaaccctgcaggagattggtaacatcatgggtgtgagcagggagagaatccggcagatcgagtctggcgcgttccggaaactaaggagcaagaagaaggtgaaggctttgaaggattatctggtgccagtaggcaattggtgaaccgtttgtttgcagaatttgttttccttttggttccttttttttttgaggattctgtacttgtaccattttacgtgggtcctcatgtaaaacacgctatcagaatacttgcatcacaagaggaaagagtagtttagttccgtgggaaatgaagtaaaattcacaattt

SEQ ID NO: 8728 - DNA, 1080 bp, Zea mays
accacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagctttt

SEQ ID NO: 8729 - DNA, 721 bp, Zea mays
ctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtttctcc

SEQ ID NO: 8730 - DNA, 631 bp, Zea mays
cagaccaccaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtcaacgtggagaggtcgtttgccgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggtttcccgagggccttgctgattggcagagcagccagcacccctggatctacgagaagtaaacagtgaaagtttcacatgaaaccttgagagctagaggaagcatgtcaccatttgtgctttagcaaagttttcgaaaagattatgatctgtatcttggaaccttatttccatggaccaaatttatttctttgccatgc

SEQ ID NO: 8731 - DNA, 744 bp, Zea mays
aattgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtt

SEQ ID NO: 8732 - DNA, 806 bp, Zea mays
cttatcatccccatccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgatcttagactcccaactgatgagactcttgtggcccagatcaaggaagggtttgaaagtggcaaggatcttgttgtgactgtccagtctgctatgggggaggagcagatctgcgcgctgaaggatgttggccccaagtaacttccctgccttggaataccgtatctcaaaacctaaatcgaaaaaagaagtgtatcaaggattgctacagagacatccatctggcttgagctggcttttgctatgtcaaacacaagtgcagggatcgctgggtgttgcaccgtgtctgcattatctgtggttacattctggaccctgtattttctatgcttttatgcccctactgtttagtattaattatcaataaatttgtttgggacggttg

SEQ ID NO: 8733 - DNA, 779 bp, Zea mays
ctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 8734 - DNA, 744 bp, Zea mays
tcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgtttagttgtttacgtttctcc

SEQ ID NO: 8735 - DNA, 1612 bp, Zea mays
tcgctctagttatggcggatcttgacatggagcattaggagtttctttcgtcgaaggcggaaggagcttgctgtaagctgcaatgtctctcaagagcattgtgcgggagctgaaggagatgagggacggtatcgggagcatgtcgagacgcggcggcagcggctccgacgggcgtgccttccacggccgctcggggtcgcggcattcttggcccagcctgtgggcggagcagcaacagtcgcatcggcagggccagggcctgggtccgggcccggaggggccgcatcatcagcatcaggggcggtgggcgaacttgcctccggaactgctgctggatgtgatacagagggtggagtccagcgaggcgacgtggccggcgcggcgccaggtcgtggcatgcgcagccatttgccgatcatggcgcgaggtcaccaaggaggtggtgaagacgctcgaggagtgtggcaggatcaccttccccatatcccttaagcagccggggcctcgtgaaatgccggtccaatgttttgtgaggagggagagggcaacatccacatatctactctacctagggctcagcccatctatgaatgtggagaaagacaagttattgcttgctgcccgtaaggtcaggcgtgccacaaggacttattttgtgatatcactggtctctgatgatttctctcactctagtagcacctacgttggcaaactgaagccaaacttcctcggcacaaagttcacaatcttcgacagccagcctcctcctgacgctgtagtgctaccaaacaataagacaagcaaaaggcagtccaagcaagtatcaccgagactgccgctaggcaattacaatgttgctacagtcacgtacgagctcaccgtcctacgcaacaggggtccaaggagaatgcaatgcaccatgcactcaataccagctgagtgcatccaggagggcgggaaggcccctacccctacaggcgccatccagtcgcttgacgagccagtgtcgtccaccttacctagtgccaaagggaaggaagtggctgtagaattctcttcgacaagcctcagcgccgatctgtctggaccggcctgcgtgaacggaacacctctagtgctgaagaacaaagctcctcgttggcatgagcagctgcagtgttggtgcctcaacttccgggggcgtgtcaccgtcgcgtcagtgaagaacttccagctcgtcgcctctgttgatccttccctaaacatccccgcagcggagcaggagaaggtgatcctccagtttgggaagataggcaaggatatattcaccatggactaccggtacccactctcggcgttccaggcctttgcgatctgcctgaccagcttcgacaccaaaccggcctgcgaatgattgacggtagtttaaaatcgcgggtggagtcttgtgtacgtccgtgttcttccagggcgatgtaaattctttatcttgccatgctgggcctctgctgcccaggcgaaatggtagcttgtgaggtggagatgagcgatagcatctgtaccataggaagagatttgagcgaccttgtttacccaactgttatatgtattattgctgggatgtttggctgtg

SEQ ID NO: 8736 - DNA, 922 bp, Zea mays
gagggcgggggcgaaggggatggcaaagcgccggcgccacgagttggcgccggtcgtggaggagctgatttcgccgatgaacagcctggacgacggctgcctcatgcacatcttcagcttcctgagcccaatcccagataggtataacaccgccctcgtttgccacagatggcgcttccttgcatgccaccctcggctatggctgcgtgttgagaggccaatcagagatgcgatggagcctggagtttatcctgatctcgaggctgctgtttctgctgctaggccgggtgacaccattcttattgcggctggtggttcccatgttgcatgtaacatccaaataaagaagcctatttgcataattggcgggggcgatcttcctgatgacactgtattgacctgctcacgtggcttcgacaacgcactggagtttctatcaacatgcaagattgcaaatctgactattagagcagaactcggatgctgcttgctgcatcgaggcggtagattgaccatccaggagtgtctgctgcagtgcgagcaaaaccctttggaccacctgtccttcccaataatcagcacagcgatagagtacgatccattctcatccctcaaggagcaagggcacggagtaacggtcgtccgcaccaggatcgaaggaggcgcgagggccgtcaggacgaacggcacactcgcgctgcgccatgtgcgggccatctattcccgcagctctgttttcttctggttcgaagtaggagagaaagtagaagcgcctgtacactagcaaaaaaacccgtgttcgttcttgtatgtcagtgttggtatcaccctagcgtgcgtttggtgaactcggacggctgcctcgtgtctgttgtgatctctttataattataataccccactgatgtttgaaccaacaaac

SEQ ID NO: 8737 - DNA, 1773 bp, Zea mays
ccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccctccgagcccacccacaccaaggtgaagcagctgctcttctccctcctgctctcccgcaaggacgacgtgatccccaccttccgctccaacttctcctcgctcctcgccaccgtggaggcggagctggccaagggcggcaaggccgagttcaacaagctcaacgacgtcacctccttcgacttcatcggcgaggcctacttcggcgtgcgcccctcggcgaccgagctcggcaagggcgggccgagcaaggcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaataagacttctctctcaccctcggccccaccttcacgtgtgattggaggtgtttgtcgcttttgtaataattataatgcaggatggcatgttgcataaattgctccccaaaaaaaatcttatctttcacaag

SEQ ID NO: 8738 - DNA, 1268 bp, Zea mays
tggctgtcgtcggcgtcgcgctcctcgctcggcgccgccgtcggcggggaggccaaggtcacgccggaggcggatccggcggcgcagcacgacgaggccgacgaggagcgctggtcgcgcctgctgccggagctgctcacggagatcatgcggcgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaatttcaaccttttctctctatctcagcttaacgcaggccctaacggataaagggaagttccttttggctgctcgaaggttcagacaaggagcacatacagaatatatcatctcttatgactatgatgatctgcacccaagaagcagttcatatgttggaaagttgagatctgacttcttggggacaaagttcatcatctatgatacccaggcgccatatgacggtgccaaaccttctaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccatccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggtggtccatggggcgtcggagacgaggagacggtgatcctgcagttcgggaagatcgaggacgatgcgtttacgatggactaccggcagcctctgtctgccttccaggcgttcgccatctgcctcaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgattgatttatatatatatgatgtgcgcctatgttgttg

SEQ ID NO: 8739 - DNA, 2229 bp, Zea mays
caacagagaagagcggacgccaccggacgccaccgccgccaatcaatagattaggcgcggataatggtgctggccggaccgcgacgggcggaggagggcgccgcggcccccgcccgccgccgctgacagagtatacctgcttaaccagccgtctgcaggcacggcgcacgcgcggtggtacctcgcgaggggctcgggttgactgggcgctactcgtggccgcggggatggaggaggaggcgtctgcagatccaccgaccgcttcgtcctgcaccggcgtctctggttccggccgctgctgaatccgacgcttcggttcgcgtccccagtccccttggcggaggcgtggatcgtgtgtttggggggtttgggtatggtgggcggcggtgagggggatcgcgtgggcggcggcgtaggggttgggggaggccagcagttcgtggaccgcagcaaggtgaggattcttctctgcgacggcgacgccagcagctcccgggaggtgctgcggctcctctgcaactgctcgtaccatgtaacttgcgccaagtctccgcggcaggtgatcaatattctcaactacgagggcggcgagatcgacatcatcctggctgaggttgatctgccggtctccaagtgcttcaagatgctcaagtacattgccaggaacaaggacctgcgccacatccccatcatcagtaggcagccttcctattctgagccttgtgcggttgtgcctattactgtgatgtgctttctgtgaccgtcctccctgtcttatggaactgtgcagtgatgtccaacagagacgaggtgtctgttgttgtcaagtgcttgaggcttggtgcggccgagtacctggtgaagccgctgcgcacgaatgagctgctgaacctttggacccatgtgtggcggcggagacggatgcttggtttgcccgagaaaaacttcttcaatgacaacttcgagttggtgctctcagaacctagtgatgcaaataccaatagcgccaccctcctctcagatgagacagacgacaggcctaaagaaaacacaaatcaagaaacgggcacctcaaatcagcttgaatacgagtctaatccttccgttgctgagcgcgaccagagagacaagatcggtgctccaggctctgccctagatgccagtcaatcatcgactccgggaagaatgttttcacgtcctataaaaactaacctgaaggttgctgagtcgtctgcatttctagcatatgttaagtcaagcaccccagccaccagttcatttgatagcggactacaaagaggtgacagccggttagattctttggataaccatggtaattgctctagtgcaacagatagaagtgacaccggtactgatgtaaatattcggaataaagaagcttttgagatgcctgtgcagtatcctatggtatgcttttcttcctctagcatgcatatggagcgaagcaatgaaggccataatgacacttcaggaactccacctgcataccatttcccattttattatccagggatggtagaacacaacatggcactttcatcagtgcaaaattttcaagcaaacataaacagtgctcaagcacatacaccaccagcgatgcttcatcagtacaatgttttctcccaatgccatagtttacccatgatatcaccatttcagtttaatacttctggcatgagtatgcactcaagtcatttaccgacgcaaaatgtgtggtcatcggcatcgagcacaccaacgcctgacgaaacatgcaatcgctccgagagaagggctgcagcacttgctaaattcaggcagaaaaggaaagagcgctgttttgacaagaaggtgaggtatgtgaacaggaagaaacttgctgagacgaggctaagggtgcgaggtcaatttgttaggcatgcaagcaatatggatatcataagcactggagatgacatatctgaagacgaagatgacgatccaacctccagggaggtagatatgatttcttctccagagtagtggagaggtcctcttgtgtgaaaaattagagtgcagatggttactgctcactttgttacaactcagtaggactagacaatacattcttctactggcaacaaggcaatacaccctttttgctcacacacagtataaacttttgtccccaaatatctggctgttactccggttgctttaatcgagaaatcatctttttgataaaaaaaa

SEQ ID NO: 8740 - DNA, 1591 bp, Zea mays
tagggttctagcgcctatctggtttctccctgcgccgccgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagtcgggaacccggaagggcgagaaccccgagaaggcctccatcgaggtcgtgtggaagcccaagaccggccagatcggtaccctgctcttcccctcgagttcgcttcgccccacggctgcgcgtgttaccgggtcactgaaatggcgagttgtttttgcaggaaggcaagagagggaatatgagatgacactcaagaggacgttgcagagcatctgcttgctcacagttcatcctaacaccacctctgtcgtgcttcaggttgtgggtgatgatggttctgtatctttccacttgatgtagcagtaatatagtttggctgcttttatgtttattgtgtttgttgtcctgcattcaatattaaagcttcaaactttagtctactgactgttagctaatgatttttttgataaatttgctaggatcaattaggtagtaacttatagggaataatgtatgaaggcatgagcgaatcggtcacatcaactaggtttggaattagagagagttgaatctttgtcggatatctttggctcttccttgaaatgtagttcgttgccaaaacatcatgcgcactccaagaccttttaactcaaaatatgagtagcttctttttttcaatcgaagctagtccttgtttccttgacagtgcttagcttatgtcatgtgcaattaatgcttcttgtgctgctcttgcatttgctggaatccctatgaaacatctcgctgtcgcgattagctgtggagtgatggacaatggtgtggttatcttagacactagcagagcagaagagcagcaagctaggtcgtttgctcacctggtgtttccgaactcgcgcaagtcagtcgaatcgaaggacacgacacagcgagatgaggagtccgagcgaggattgataacttgcatcacgcatggagcaatgtccgaggatgactatttcaactgcatagagaggggtgtcatggcgtcctcgaggatctcggatttcatgaggaagacactgcagaaggaggcttccagggatgcctgacctgagtagcaaatgtattagcacgactgagaagctgcctgcctgtgataggcgatggcgatggcaatggtgtgtagacagcagctgggtctctagttttgacggcatgtagtcgtgttagaatgaaggaggcaagggtgcgatggagtggaggtcaatcggcgtgtgatgccacgtcactagcttagctgcggatggtttggtggacttttgaggaacagataatgagattgtatgcacggcacgctgaaattttacttgaacgccgcccgattaaaacaatatccatactgtacgtgtgtcggtgggctgcaatgtgatgtgtgatatgaaaaaa

SEQ ID NO: 8741 - DNA, 793 bp, Zea mays
cacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccggcggcatcctgcatcgctccggcagctccagctccagctcgtcggaggacgacggcatgggcggaaggaggaagaagggaatcaaggagaagatcaaagagaagctgcccggaggccacaaggacgaccagcacgccacggcgacgaccggcggcgcctatgggcagcagggacacaccggcagcgcctacgggcagcagggacacaccggcggcgcctacgccaccggcaccgagggcaccggcgagaagaaaggcattatggacaagatcaaggagaagctgcccggacagcactgagcggcgcctatacgtggctgtgctgtgctgtgctggcgcgtcaaagccgtactcttcagcgttccatagataataagataaacccatgaataagtgtccctaccctttgatcatgtgacagggacagggacagtttcctgtacttgtggggtgaatttgtacgtgtgatacggtaacttggtccgtgtactgtttatgctgctacgttttccttcct

SEQ ID NO: 8742 - DNA, 737 bp, Zea mays
cgatccaattgtcacttgctctccctccaacaagctaattaaggccggtcgtcatccctcttctagctcgttttattatccatggcggaggagaagcaccaccaccaccacctgttccaccataagaaggacgaggagcaggaggagcagctcgccggcggcgggtacggcgagtccgccgagtacacggaggccacggtgacggaggtggtgtccacgggcgagaacgagtacgacgagtacaaggaggagaagcagcataagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatccctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttacatgttt

SEQ ID NO: 8743 - DNA, 1873 bp, Zea mays
ctctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctcaagagcatacttaaagacggatcctgatttgcgttg

SEQ ID NO: 8744 - DNA, 869 bp, Zea mays
caaccgcatcgcttccctcccggcagaagaagaagattcggttgggttgtttgtctcttgcaaaccgcaatggctgctgctgccactgctactccggccgtggcgccggaggccggcgaccggaaggcggtggcaccgccggtcgacgcggtggatctggagctggagctggaggagaagcacgtgctggcggtggacgacagctccgtggaccgcgcggtgatcgccaagatcctacgcagctccaaatacagagtgacgaccgtggactcggcgacgcgcgcgctggagctgctggcgctggggctggtccccgacgtgaacatgatcatcacggactactggatgcccgggatgaccgggtacgagctgctgaagcacgtgaaggagtcgtcggcgctgcgggccatcccggtggtgatcatgtcgtcggagaacgtgcccacccgcatcagccggtgcctggaggagggcgccgaggacttcctcctcaagcccgtccgccccgccgacgtctcccgcctctgcagccggatccggtgaccgcccgcgcaaggatggaggatctggttgcgcgctctgacttaattagaggagttgttaggatccaattttttgtgtgttcgttcgttcgttcgttcttttctttctttcttcttggacatagatctgctgccgccgctgctgccgtcgactgaaacaagaagctaacttagttttagggtccaggttgttgttgttgttgttaggaaggcgagtcgttgggggcattcacggatgttcttcctcgtttcccctccctccgtgcctgaggctgcaaaaatatgccccccagacatgaaaaaaaaacaagacctgttaacagttcc

SEQ ID NO: 8745 - DNA, 1542 bp, Zea mays
cgcggactagttttttctgaagattcggcgatggcggcgacgatccaatccgtgaaggcgcgccagatctttgacagccgcggcaaccctacagtcgaggtcgacgtgttttgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacgaatgttggtgacgaaggtggttttgctccgaacatccaggagaacaaggaaggacttgagctcttgaaaactgcaattgagaaggctggatacactggcaaggttgtcatcggaatggatgttgctgcttcggagttttacagtgacaaggaccaaacctatgacctcaactttaaggaggagaataatgatggttcacagaagatatctggcgatagcttaaagaatgtatacaaatcttttgtgagcgaataccccattgtttcgattgaagatccttttgaccaggatgactgggttcactatgctaagatgactgaagaaattggagagcaagtgcagattgttggtgatgaccttctcgtcaccaaccccactagggttgctaaggctatcaaggagaaatcatgcaatgcccttctgctcaaggttaaccaaatcggatctgtgactgagagtattgaggctgtgaagatgtcaaagcgtgcgggctggggtgtgatgactagtcataggagtggtgagactgaggacactttcattgctgatctggcagttggtttgtccacgggtcagattaagactggagcaccctgcagatcagagcgtcttgccaaatacaaccagcttcttaggattgaagaagagcttggcgctattgctgtctacgcaggtgccaaattccgtgcacctgtggagccctactaaacgggcgggatgcaagtgcttttatgtctgcacaagtcctgtgaaactgtttactgcgacctgcagattttactcttggagtgccctgagtagattttagcaataatatccaacatgtaacatgttacggacatgtacccaaacgtgatccagttttagttaatgtgctcc

SEQ ID NO: 8746 - DNA, 1357 bp, Zea mays
cacacctcaaaggaagatacttcgcctgagggttcaggtactaccgagagaactggagcctggagtaacatgttgaacactcttatgcagcaagcctcaatctatggtgtggctgctgggtattgtttatcagcgtcgctgctctcgatcatcaacaaatgggcagtcatgaaatttccatatcctggagccctgacagctctgcagtatttcactagtgttgctggagttctcctatgcggacagctcaagctcattgagcatgacggccttaatttgaggacaatgtggaagttcttacctgctgcagtgatgttctatatctccatcttcacaaacagtgaactcctgcttcatgccaacgtggatactttcattgtgttccgctctgctgtgcctatatttgtcgcgataggagagacgctgtatctccatcagccatggccatcactcaagacatggctttcactctccacaatacttggtggaagtgtgatctatgttttcacagacaaccaattcactgtgactgcttacacctgggcagtggcctacctagcaagcatgtccattgatttcgtgtacatcaagcatgttgtaatgaccattgggctgaacacatggggccttgtgctatacaacaaccttgaggctttgatgctattcccactcgagcttctcgtaatgggagaatttgatcagatgaaggtcgacagctccaaagtgtcaaactggctttcatttgatgtggtcctccctgttgctctctcatgcctgtttggattatcaatatccttcttcggattctcctgcagacgagctatttctgctactgggttcacagtgcttggcatagttaacaagctcctaactgttgtgattaatttgcttatctgggacaagcatgcctcttttgtgggtaccattgggctcttgatatgcatgtcaggtggtgtgctctaccagcaatccaccacgaaaccgaaggcgcccaaggttgagccgaaggaagagaacgacgaggagcagcagaaattgctgcagatgcagggagttcaagagagttcataaaccttacaaagaaagtacaactacaaagaagcatatggctagtacttggaaagaggacagcctcacctgaacgtttttgtattggctagtacttgggaagaagcatatggatgaatgtagtcatgaactaggagctacaaaatcccatgttttagatattagaagtcatggaggggacctaattatcactgtgcaattctttattactatactaccacttccatttgtagcgcaaaattgttatgataggatggcaaatatacctgcattgaatactttccatacg

SEQ ID NO: 8747 - DNA, 1397 bp, Zea mays
gagaggtgcaacgtcttctccgtgcttaccactcgccattcctaagtcctaactacctccacccccgcacgcacaactggccgcaccaaggcaaagctagaagaagacaacgcaaagggagaggacagaggaggagcagaggacgatgggcagcggcggcgctaacactgcccccctcatcaccccctacaagatgggaaaattcgatgtttcccacagggtagtcctcgcaccactgacgagacagcggtcctacggcaacgttcctcagcctcatgccatactgtactatcagcagagggcgactaaaggaggtcttctgatagctgaggccacgggggtttcagacactgcccaagggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcctgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatggaaatcgcgcgatctccactgggtatgctgatttggtcgcgttcgggcgcttgttcttggctaatcctgacctgcctcggaggtttgaagtagacgctccccttaacaagtacaacagagacacgttttacatccctgatccggttgttggatacactgactacccatttctttcgtcagatgtataaatgttctcttttcagcaatctgcttttttagattgagtagtaactggttggtgtaccagtaaaatattagaggaataaaccattggtctgaatgcctcattctcatatatatggacaaaagcaatatgatcgttgt

SEQ ID NO: 8748 - DNA, 1671 bp, Zea mays
ctcggcagcaggacccgccgccgcctcctctccatctctttctctctctctcgccatatcgattccattggggacgcaagcaccgccccagacccagagcttctcttctcaaaagatgcaggagcaggacgtggacgatggcggcggcaggacgacccagcagcaggagaagtcgatcgacgactggctccctatcaactcctccaggaaggccaagtggtggtactccgccttccacaatgtcaccgccatggtcggcgccggcgtgctcggcctcccctacgccatgtccgagcttggctggggccctggcatcgcggtgatgatcctgtcgtggataatcaccctatacacgctatggcagatggtggagatgcacgagatggtgcctgggaagcggttcgaccggtaccacgagctcgggcagcacgtcttcggcgacaggctgggcctctggatcgtggtgccgcagcagctggcagtagaggtgagcctgaacatcatctacatggtcaccggcggccagtccctcaagaagttccacgacgtcatctgcgacggcggcaggtgcggcggcgacttgaagctctcctacttcatcatgatcttcgcctccgtccacctggtcctctcccagctccccaacttcaactccatctccgccgtgtcgctcgccgccgccgtcatgtcgctcagttactccaccattgcgtggggcgcgtcgctgcacagagggaggagagaggacgtggactaccacctgcgcgccacgaccaccccagggaaggtgttcggcttcctgggaggcctaggggacgtggcgttcgcctactcggggcacaacgtggtgctggagatccaggccaccatcccgtccacgccggacaagccgtccaagaaggccatgtggaagggcgcctttgtcgcctacgtcgtcgtcgccatctgctacttccccgtcacgttcgtcgggtactgggccttcggcagcggcgtcgacgagaacatcctcatcacgctctccaagcccaagtggctcattgccctcgccaacatgatggtcgtcgtccatgtcattggcagttaccaggtttatgccatgccggtgtttgacatgatagagacggtgctggtcaagaaaatgaggttcgctccgagcctcacgctccgtcttattgcccggagcgtctatgttgcgttcacaatgtttctaggcatcactttccccttcttcggtggattgctcagtttcttcggcggattagccttcgcaccgacaacttattttcttccctgcatcatgtggctcaaggtttacaagcccaaacggttcggcctttcatggttcatcaactggatctgcatcgttattggagtgctgctgttgattctgggtccgataggagggctccggcagatcattttgtcagccaccacatacaaattctaccagtaaaatcgatcaactggagtcgtatggcgtggctgttttgttagcattacatttcttagggtggattggcttttaatgtacacgagcgagtgagattgatgctagtagctcctaggagtatatatatttctatcatccacagagcttaatgtatcttgtagttgggacaaaaaaaaaaaaaaaaaaaaaaaaaaaaaaaaaaaaaaaaaaaaaaaaaa

SEQ ID NO: 8749 - DNA, 2205 bp, Zea mays
tcctgccaacacaagccgttttttcctccccgagtgatctagccagacacggagccaccactcgccaggtgcctcaaatagtcgccccggacaggcaggcgcacgcaacgcaactagtctccttcaccgtccgtccattcctccgatccgcaggaggattaggaacttaggatcggggaccggcggagcccgacgaccttctcggtccacccgcccggcgatcgaaccatggcgctcggcgagggcggggatcacggcgccgccctgcccctcatcgcggaccaggcgaaacatgccgccgccggtggcatcgtccgaagcgggagcatgtggacggcagcggcacacgtgatcacggcggtgatcgggtccggcgtgctgtcgctggcgtggagcatcgcgcagctggggtgggtggccgggccggccgccatgctcgtcttcgcggccgtgacggcgctccagtccacgctcttcgccgactgctaccggtcgccggaccccgagcacggccctcaccgcaaccgcacctacgccaaagccgtggaccgcaacctaggtagcagcagctcgtgggtgtgcatgcttctgcagcacacggccctgttcggctatggcatcgcctacaccatcacggcctccatcagctgcaggcaagaagcatacctgggcttgcggctcgctgcagtacgtgagcctgtacggctgcggcgtcgcctaccatcaccaccgccactagcataaggtagccgccgttggccggtaacaaaatttcccagtctctctctctctctcaaaacttcctcacagctcaagctgcctgcagtcgtgtgcttccttccctctctttttagcgagcagggcgctgacgatggttgcttctgttgtccttctgccggttaaatttctctgaatatttttgttcttaactgcgcgtgctttgcttgtgtgttccatacgtgtcgggctgctctgctgttggatgtcgcagggcgatcctgaaggcgaactgctaccacgagcatgggcatgacgcgcactgcgactacgatggcaactactacatgctcatcttcggcggcgtccagctcctcctctccttcatacctgacttccacgacatggcgtggctctccgtcgtcgccgcggccatgtcgttctcgtacgccttcatcggcctcggcctcggcctcgcaagaaccattgctaacgggacgatcaaaggaagcataacaggtgttcggatgaggacgcctatgcagaaggtttggcgcgtctcgcaggccatcggcgacattgccttcgcgtacccctactctttgatcctcctggaaatacaggacaccctgaagtcaccgccggccgagaacaagacgatgaagagggcgtcgatgatctcgatccttgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctctttggcggagcggttcccggacagcgggttcgtgaacggcggctcctacaccgtccggttcgcgtgcctgcgagcgtgccgggtgaacccgctgcgcgtgtgcctccggacgctgtacgtggcctccacgacggcggtggccgtggcgttaccctacttcaacgaggtgctggcgctgctgggcgcgctcagcttctggccgctggccatctacttccccgtggagatgtacttcatccagcggaacgtgcgccggtggtccgcccgctgggtcgtcctgcagaccttcagcgtcgtctgcctgctcgtcagcgccttcgcgctcgtcggctccatcgaggggctaatcagcaagaagctaggctaggctagtccgatccagtggaacaccctatctgcaggtctgtcagagagtggcagcgggctcggttattttcacagtgttgccttcctcctgcatcgggttgtaagttgtaagatatatgtcgtattgatactggcgagttcagatgttcagaagaagtagaacgcgtgtgacgattctgtgttgctgaatgccgcctatgtagtttcagttccagaatttgagggtttccat

SEQ ID NO: 8750 - DNA, 1740 bp, Zea mays
cgacactcacaagaacctgcctccctctggatcgctatctcttttctagtgcccagggaaagctagctagctcacagctgagctgagggaagaaagcaaggagagggagccagggaggaaggggaaaaacacgcggagagggtgagcaagaaagaaccgaggcggatcgccttctgttcctcctgccggctccgcgagaggaggcactgctcaggggggaagaaagaggtggaacaacgccccggggcagagcagagatgatgcgggagacgtacatggacgtgctgccgccggtggaccacatagccgcacggagcaactggttcccggcggcggcgcgtctgtggacggcggcggagaacaagcagttcgagcgggcgctcgccgggctcgacctctgccgcccggactgggaggaggtggcgcgggccatccccggccggacggtgcgcgaggtcgtcagccacttcaagcacctcgaggtcgacgtccagcagatcgagagcgggcaggtgcccttgccggcctacggcggcggggccagctcgttcaccctgcagtgggacggctacggccccggtccgggggacttcaggcacgggtaccgcttcgccggaggctgcgggaggcggcaccacggccgcacgccggagcaggagcggaagaagggcgtgccatggacggaggaggagcacaggttgttcctcctaggcctgaagaaatacggcaagggtgactggaggaacatttcgcgcaacttcgtccagaccaggacgcccacccaggtggccagccacgcgcagaagtacttcatcaggctcaactccggcggcaaggacaagaggaggtccagcatccacgacatcaccacggtcaacctgacggacgaccagccgccctcgccgtcccagtcctccctaatcaccagccaatcgaacgcaccagctccagctccggccgcggggatatgccaggtcccattggcggccgacgccaagcgacacggtgccggaactctgcccttcagctcaccgaaccggacctctgcggcgccggcctacaggatggagtttcatgaccaacaaggcctgcagtgtggccctctgcatgatcagttgctcgccagccagagcgtcctgttctaggcgcggtggcagcccaccctgcggcatggatcgaccaggtgcctagtgtataatacttgtggtatcgctctagcttcagcgcctgtattgaagggattagccttttgggagcataacagaaaggaggtcttcatttcatggtggtccataatttgttggagaatgtaacaaaaggaacgccgagaattcgatgccatggtattttcagactgttgctcgagtggtatggctggaaacgtatcatgcatcctatgaagtggacttgcattcaatcatggatgatcctatgaagtgtcggttaaccttggttgtgaccatctgattctgctgctgtctctgaagatggtgccttatattgaggccttccgagttcaaaccattctgtagtgtccagacatatttatccgtagtaatcagtttgcctattggtggtggtgcctgcctcaatctatgtttggagtttggacaagtttaattttctcgtatgaacgaatttcggtgaagagaagataaacgaagctgagtttgcaatgagtcactcagcattgctgctacttgtcaatatctctcatatagtcaactttttgctttggtt

SEQ ID NO: 8751 - DNA, 1883 bp, Zea mays
cgtgtttttggcaggactgactttgcaaagttaaaggacatgttgacaaagcctgataaggctgatgataaagaggaaattacgtctggatcaaccgatgctcaggaaacttctcaatccaccaatgatgaagtgttggtaactgaaatatctgaaaaatcactgagtaaaaaaaaaaaaaaagggctgactggcgaggcaaaagcgcaaacgcgaccacagacagagcgcgcttcaaggccttttttttttgagataacaaggaggagaggaggagatggcggtcacgatcacctgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaacgtaaacaacattattggaccagcgattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatgatcctcccaactggtgcctcctcgttcaaggaggccatgaagatgggagttgaggtgtaccacaacctgaagagcataatcaagaagaagtacggtcaggatgcgacaaacgttggggatgaaggtggttttgcacctaacattcaggaaaacaaagaaggccttgaactattgaaggcagccatagaaaaggctggctacactggaaaggtggtcattggaatggatgttgctgcttctgaattcttcggtgagaaagacaagacttatgatcttaatttcaaggaggagaacaacgatggctcaaacaaaatttcaggcgacagcctgaaagacctgtacaagtcctttgtttctgagtaccctatcgagtcgatcgaagacccatttgatcaggatgactggagcacttatgccaaactcactgatgagattggacagaaagtgcagattgtaggagatgatcttctcgttaccaaccccaccagggtcgccaaggccatcaatgagaagacctgcaatgctctcctcttgaaggtgaaccaaatcgggtctgtgaccgagagtatcgaagctgtcaggatgtccaagcgcgccggatggggagtgatggcaagccacaggagtggcgagacagaggacaccttcattgctgacctctcagttggcctgtctacgggccaaatcaagacgggagccccttgccggtctgagcgcctggccaaatacaaccagctgctcaggatcgaggaagagctcggtgatgccgcggtctacgccggagcaaagttcagggcaccagtggagccctactaagaaaggaagaggatgaggatgttttcttgtggagctatactagctcgctgctgccttttgttacaatgtttgtacggtcgcaataaatgtatggtcgtgtttgctcgagagctactcaggtgattttgtcgtgggagcaccaaaagcagaaaagaacccttttttttcaatctctctagattctgacgagtggtggtctgcactcgtcgtaatgtcgtttgcctaaactgattttgatggaacaggaaatcttgctggtcttgcc

SEQ ID NO: 8752 - DNA, 830 bp, Zea mays
ttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8753 - DNA, 779 bp, Zea mays; identical to SEQ ID NO: 8733

SEQ ID NO: 8754 - DNA, 808 bp, Zea mays
ttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8755 - DNA, 1092 bp, Zea mays
gggaaagggaggacagcagagcagaggtcgagcatcgcatcgcatcgcatcgcgcgctttgcctgccgcagcggctaacgaacgcgtggatcatcccttctattattaattaattgggaggagtgggagtgatagctgcagcacccagcgcccatcactgagcccatccggaaccctagcctcctcgtcgttgaatccaccacaccatgagcgggagcgcctccaggaagctcttccaggccgccaggtccatcgtcctctccgcttctcaacgctcctccttctccgtcctcgccgccgagggccgcaccgccgcgctcgccaactttggcaggaagatcctccccagcgcctgctcctaccacaggcagggatcccacgccgcgtcgggatggggagccatcgctgccgcagtccccgccgcagtttacatgctccaggaccaggaggctcatgctgcagagatggagcgcactttcatcgccatcaagcccgacggcgtccaaagaggcctgatttctgagattgtgaaccgattcgagagaaaaggctacaagcttgttgccatcaagctgattgtcccatccaaaggattcgctgagaagcactaccatgatctcaaggaaaggcctttcttcaacgggttgtgtgacttcctcagctctggccctgtacttgcaatggtttgggaaggagagggtgtcatcaagtatgggagaaaactaattggtgccacagacccacagaaatctgaaccaggaaccatcaggggcgatcttggtgttgttgtgggaagaaacatcattcatggaagtgatggcccggagacagcaaaggatgagatcgccttgtggtttgaacccaaggagctggtctcttataccagcaatgcggagaagtgggtctatggggtgaattaaccagcgactaaatctcttgaggtttgcttttttcttttcagttttcacataattgccgacagaccaaggcaggatgtaataaagtagctaccgtcacctattacttttgagttggattgattgtggtgcagtaaggcacaaggaaaggaaggaatacaccgtgaaatttgtt

SEQ ID NO: 8756 - DNA, 1091 bp, Zea mays
ctccaggcagctcctctccctctctgtcgccgacgactacgccaggtcttcttcggggcccaggtcgctgccgcctacatcaggggccccaagttttcctacttcctaggacccctcgccggcgacgagcaccaccagcttggttcactcccaacaaaatgtcagccaatgtgggtgaatcaactagcggtgtcagcagcagcgatgcagctggggggagctttgagtgcaacatatgcttcgagctgcctcaggagccaatagtgactctctgtggccacctcttctgctggccgtgcctttaccggtggctgcacattcacgcacactcgccagagtgcccagtgtgcaaggccctcgtggaggaggacaagctcgtccccctttatgggcgtggcaaggatcgcgtcgacccgaggtcgaagaacatgcccgagggcgagattcctcaccgcccaactggccagaggcccgccacagccccccgggccgatgctaacagcaactttgccaatgccaatgccaatccatggttcccgggcacaggagtccctctggcaaatgcgcgatgggggaactacgcattctcagctgctttcgggggactgttccctatgcttagcttccaagttcatgggtttccagatgccgccgcttacgcgcagcctgctgggttccactatggatacgggcatgggcatgggcatgggttccaccatggcgggcatatgggacaagcacaagcccatggcgtccaccgacaggcaccgttggggcaacaacagcagcaggcagatatttatctgaaggccctgctcttcatgattgtaattctagtgctcgcaagcctcctcgcgttttaaagcttgtttggcaacgtctcctcgtcatggtttggaaattgtaattctggggagtgctcctcctggcatttcagtgctgttggcatggcagtttgacattgtgatggcgtattggcctatgagaatcgccagaatatttcactgttggatctgtactatagcctggtgctgaatgtcgtataagggctagttttgcaacaccattttctaagagatctctattttctc

SEQ ID NO: 8757 - DNA, 1813 bp, Zea mays
taaattttatgtgtatctatgctaaaatattagatttatcatataagttggatgttttaggaacatccctcagtgccatgttgattatttggtggaatttgttttgtttccgcaatatcagggtagggtatttcttaaataagtttacccctgttataattatgtccctaggttgtggttctcggagtagttctgttataactctttgtgctaggttgtgatgctcgaaatagttttgtccttgtgcctgaattctagctatcatgtctaaaactcgtgatcaagcagaagttagtttcatgatatcaacttttaattcagcttcattacacagctcaaatttcatttacgggataaggttccacctccagattaagctctaaatttgttcatgcatgcttgtgtactggatgtaaaacgatcaaacaacccaagttggaagcatgccatttaaatgttcagagaaaatttctaggcgtagctaaaaactgattctgcctatttgttgcaaataattgctttattgagactcaaatttcatggttatgtgcagcttgcttagtattgcatattatccttcgtatcagctctattatgtcttttctgcacaattatatttatatttgggttattatttgaatttgggattgagagatggggggttattctccttttcttttctctttttgggactggattatctgaagggcaatgatgggaggctggggggtttcggatgggtacgagggatcaaagaggacacgaatgatgatggaatcgaatccctacttcgcagtgaacgcagggagtccattggatgtctcaaagaggtctaggattgttgaaccaggcccgccctattttggggccatgggcagcaacactggtggtgccagtggtggcttctaccagcccttcaacagcagcaacttagctggtgcaggggctagcactggcatccaaaactttccaggtgtacggctgcgaggtctcccttttgattgcaatgacattgatatctgcaagttctttgtgggactggacatagtggactgcctcctggttaacaagaatggccgcttcactggtgaggcttttgtggtcttcccaacagctatgcaaacagaatttgctctgcatcgtaacaggcagaacatgggccggaggtatgttgaggtgttcagatgtaagaagcaggagtactacagtgcaatagccaacgaggtgagccagggtggttactttgagtcggagtgtcgccgctcctcacctcctccgaggccccctaagaagactgctgaagacaagggcagcatggagtacactgaggtgctgaagctccgtgggcttccctactctgcgacgactgaggacatcatcaagttcttcctggagtatgagctgacagaggagaatgtgcatattgcgatccgctcagatgggaaagctaccggtgaagcctttgttgagttcccaacagctgaagttgccaagacggcgatgtgcaaggataagatgactatcgggacgaggtatgtggagctgttcccgtctaccccagaggaggcgagcagggcgagaacccgaggcaggcattgaagaaacgaatggcttggctgaatgatctctggttgcatgtggctgcaatcgactgtagttttcacttcgcatgcttatctgtatcgcttttagattgtgttagttgtgtgtatttgacttcttatatgcgaactgaactgtaacaactttcctttgttggccggccgcacatgtacggcataatcatttatggattttgctacgtttgagtttc

SEQ ID NO: 8758 - DNA, 1689 bp, Zea mays
ctcctccccgttccttattcgccagaccggagggaggggtacgagcttcaccgctttcatcccgcccgcgctcctccccagatctcgtctccattaaagccgaccttgcccagattcgcgccctcctcgctcatatctgaaagcggctctgattttccaagccgaccgcaggagcggtgcaccgggccgcgtgattccggcggcttgatttggaatttgtgatctttcggggcattcgtcggtttgtctgtcggtgacggtggtgctgcgtttcgagggcagcgaagatgggtgtcggcggagagaagttccagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgctccttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggctttttgactaaccaaaacgtctttgcttttaattatacatcacaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgacccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctcccgctagacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaagattgccagatatacattgaaactagacggcagatattgtatgattgtatctggacatgttccacatcgtctaactgtaacttccaactggtacatggcatgcctatatccaaagatagatttctttttttttgtatcagaaagatccggtaagacttgcgc

SEQ ID NO: 8759 - DNA, 768 bp, Zea mays
cgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaagg

SEQ ID NO: 8760 - DNA, 803 bp, Zea mays
ctctctctcgatctcgagcgacgactcggttacagccgccgtcctacgccaggtcccaggtcttcgtcgggcccgtctccggcaacgagcaccaacaagatttttgtgtgtaaagatttgcgagcaccattcactttttcatcagtgtgaaattaaaacacttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacacgtcctttcgacaaatgtcttgatgagactgtccaggctgaagctatcttaacagccttaaatggtgtggcttcttcaagcattagcatttcaaaggatgatggttggggatcgtcagatgatgatacagatgccatagatcaagatgctgaccctgaagctgacacgacaaggttgagtttcaaggagcatcgccgtgcccactacgatgagtaccgcaaggttaaggagctgatgaggactggatcccttactgctgaggaggccgatgaggataacagagctgccaccagctccgaagacaaaggtgtggggaaaggagggccgaatgataacatgaagccctcgcctcaaacatgaggagttcatatgaaggttctgattcctctgttatttattgtatcattgtatgcaatacagttgttactcttgttttgttttgagatgctggtgtgccaaaatggatttgatgaccgataattttattggtgttggct

SEQ ID NO: 8761 - DNA, 1385 bp, Zea mays
cgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccgtcgcgctcgacaagcttgatggcgaggcctacgtcaacatccgcaagggcaaggtcatcccggggtacgagctctcgctcaccctctcctgggaggccgaggccgcctcggagtccggagctgcgaaggtcaccggcaccgctgaggttccctacctcgccgacgagaacgccgacgaggaccccgacctccgcgtcaccgtgcgcggcgacgagacgcccctcgcgctccgcgccaaggacgccttcctctcccgcgggaaacccatggtgctcgagaagatccgggagttcgtcgctgccatggccaagggtggaccggccaaggacgagctggactccaagaaaactcccacgaaggtcgccggctccgcaccggcgaaggaggcggtactggctcctgcgccggctgtggagaagaaaaaggccaaggggaaggacaaggagggcttcaagaccattgagatgacggagaagttctactgccgctcaaaggacatatatgagatcttgatggatgagaacagatggaaagggtttacgcagagcaatgcgaggatcagcagagaggttggaggggaatttagcctcttcgacgggtccatcactggcgtcaacgaggagctgcaggaagggaagctgattgcacaaaagtggcggtttggaagctggcctgacggcttgtactcctcggtccggttggtgtttgatgagcccgagtctggagttacaatcataaagctcaaacaaactgatgtgccagaggaagacaagtatggaaattcaactgtggtagagaacaccgagagaggctggagagaactcatattccagcggatacgcggagtgttcggttttgggatctaaagaatctaaagaggcgatttggcatgaagttagatttcaaatttttacggggtcagaccatgcacgtcatagcaatccatgttttattcacccatttgttttccatgtccttaaacacagaacactgcatatcgtggggggtttaaaaacatctgttattcgaacgctgcaatgttgcttgctcccgaaaaaaaaaaaaaaaaaaaaaaaaaaaaaaaaaaaaaaaaaaaaaaaaaaaaaaaaaaaaaaaaa

SEQ ID NO: 8762 - DNA, 710 bp, Zea mays
gtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaagg

SEQ ID NO: 8763 - DNA, 1134 bp, Zea mays
cgtttatttcttcccaccgagccaagctgcgacgacggcggtcgcagcgtcgccttccctccctccgtaccgccgacgccgacgagcatattgggccgagcgcccgagcacctctcctgtcagcagcggcactcgccattccaagtacgaggtcgacgcgctgtggggcttgctgaaacaggtctacccccaagtgaaatcagggtcttcaagatagcttactgagatgtggggttttgcatcaaacgcttgggcagctgggctggagaagaggagttccccaaaccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatcggttgacacttcacccaccaacgcaaatcatgccaaccacggggggtcccctctgctgaacacagggagggtacaagcttcgctgcgcaagtccctgtcgttcctggtccacctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcggaaaaaaaatctcaatgctgttgttggggtctgtgtaactgaattctccctagattttgttgcaagtgttgaagttattgcc

SEQ ID NO: 8764 - DNA, 945 bp, Zea mays
cgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacgggcagagcagctggaagaacgcctggaagaaggccggcgcctgctccggcctcagcgagaaagactacttcgagactgccctctccttccgtagccggatcaacccactcgttcgcctcaaagccaaaggtatcgagccggacttcgggctctacggcctcaaggcgatcaccaaggtcttcaagagcggcatcaacgcgacgccggtgatccagtgcagcaagggccccttcgacaagtacatgctgttccagctctacttctgcgcggcggggaacggcacgttcatcgactgccccgcgccgcagcagtacacctgctccaaggagatcctcttccaccccttcaagaagtggatgctcaagcagcagctcaaccaggacgacgaccctttccagctgcctggcgtcgccatggacaactgatacaccgtaccgtcgtctctgtttgcgtttctgtcaagtgtgcatggaataatactgtaactgtgtttcctgccgggcaatgcactgtgatatgatgcccaacgaataaatgtcgcttttatttttattcgacttcccccctgtaccgtgtggaaataaacctattataagc

SEQ ID NO: 8765 - DNA, 1136 bp, Zea mays
cgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcct

SEQ ID NO: 8766 - DNA, 800 bp, Zea mays
ggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaagg

SEQ ID NO: 8767 - DNA, 762 bp, Zea mays
cgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagaggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 8768 - DNA, 829 bp, Zea mays
tggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8769 - DNA, 795 bp, Zea mays
agaacatactcccgctgaagcgctgagaagtagataagaataatatggggttcagtgaggcacaggaagagctcgtcctccgttcatggaaagccatgaagagcgactccgagtcgactgctcttaagttcttcctcaggatctttgagatcgcgccgggtgccaagcagatgttctccttcctgcgcgacgccggcgacgcgccgctggagaaacaccccaagctcaaggcccacgccgtcaccgtcttcgttatggcatgcgagtcggcgacgcagctgagaagcaccggcgacgtgaaggtgagggaggccaccctgaagcggctgggcgcgacgcacgccagggcgggcgtcgccgacgcgcatttcgaggtcgtcaagacggcgctgctggacaccatcagggacgcggtcccggacatgtggacgccggagatgaaggcggcgtgggaagaggcctacgaccagctggccgccgtcatcaaggaggagatgaagaacgccgccgccgccgaggagcagacgaagaacgccgccaccgccgaggaggagattaagaacgccgccgccgccgaggaggagacgacgaacgccgccgcggctgttgatggttcctagctcccactacgctcctctgctagcgaccgtggcacgcgcaccgctgcgttgatgggtgcttttggactgctgctggcctgatacctacctacgaagctgttgctaatgctgctgcatttttgtttgtcgaccgcatcattgtgatgataaataaaatgttcagaaaatgcccgtt

SEQ ID NO: 8770 - DNA, 1420 bp, Zea mays
gtcgacccacgcgtccgcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggcggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggtaaattgttgagcttgctaaagttggctgttcgaacttcctcttttaagaattgtatgatttctttagctggccattagatgggcatggtttattgcaagtgttaactactttggttgccttgttacatccacaaaatatctctgctcttgcgctgtgctgcgatgcattgttaccgcaggagaagtcactgcaggaggagaacaaggttctgcagaaggagaaagcgttactcctgcatgcagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggcggccgc

SEQ ID NO: 8771 - DNA, 1363 bp, Zea mays
cgagccctcgcccgctcagtcacaaagcctcagatctcagtcgcctgcgccgccgcttcgttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagttgctgagcatgctgcagcaaataacaaggtgttcctgatgaacctctctgctcccttcatctgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcgactatggacgtctcctttgtcgctgtataaggcatgatttgccatcattctgttgcttcggtgatgcttgcaatgcaatgagaatgtgttggaacgat

SEQ ID NO: 8772 - DNA, 721 bp, Zea mays
gcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagg

SEQ ID NO: 8773 - DNA, 636 bp, Zea mays
cgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgcc

SEQ ID NO: 8774 - DNA, 633 bp, Zea mays
aaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccggatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgcc

SEQ ID NO: 8775 - DNA, 1073 bp, Zea mays
ggtcgtcttctcgcagataccggacttcgaccagatttggtggctctccatcgtcgccgccgtcatgtccttcacctacgccaccatcggcctcgtcctcggcatcatgcagaccgtcgccaacgggggcttccagggcagcctcaccgggatcagcatcggcgccggcgtcaccccgacggagaaggtctggcggagcctgcaggccttcggcaacatcgccttcgcctattcctactccatcatcctcatcgagatccaggacacggtcaaggcgccgccgccatccgaggccaaggtgatgaagagggcgaccatggtgagcgtggccaccacaacggtgttctacatgctgtgcgggtgcatgggctacgccgccttcggcgacgccgcgccggacaacctcctcaccggcttcggcttctacgagcccttctggctgctggacatcgccaacgtcgccatcgtcgtgcacctcgtcggcgcctaccaggtcttctgccagccgctcttcgccttcgtcgagaagtgggcagcggccacgtggcccgacagcgccttcatcgcccgggagttccgcgtgggccccttcgcgctcagcctgttccgcctcacctggcgcacggcgttcgtgtgcctcaccaccgtcgccgccatgctgctccccttcttcggcgacgtcgtcggcctgctcggcgccgtctccttctggccgctcaccgtctacttccccatcgagatgtacgtcgtgcagcgcgccgtgcgcaggtggagcacgcactggatctgcctccagatgctcagcgctgcgtgcctcctcgtgtccgtcgccgccgcagcgggctccatcgccgacgtcatcggcgcgctcaaggtgtaccgcccgttcagcggctagttcagataggggcccaacgaggcgtgtgccgtgcacatgagtagtgccagtggtatctctactggtcggggtgctacattgactgtggggtcccgggttgttgtaacttgtaagatatagccaaatgaaaaacaaagctactgaactcgtgtggagttttgtcatgtagcaactt

SEQ ID NO: 8776 - DNA, 835 bp, Zea mays
cttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8777 - DNA, 711 bp, Zea mays
ataaaaagcggttcttggtgcgctctacagctcacttctagagtttagctatagcctcactgctagagcgccgccatggctcaggtaaggggcagtgctcgtggcactggcagtggcagcagcgccgccgcgctggcgctggtcctcctgtgcgcgctcctccgcggcgagttcgccgagtcggcggtgtacacggtcggcgaccgcggcgggtggagcttcaacaccgccagctggcccaacggcaagcgtttccgcgccggcgacgtcctcgtgttcaggtacgacgccagggcgcacaacgtggtgcccgtgagcgcggcggggtacagctcgtgcagcgcgcccgagggcgccagggcgctcgccaccgggaacgaccgcgtcacgctgaggcgcggcgccaactacttcatctgcagcttcccaggccactgccaggccggcatgaaggtcgccgtcaccgccgcctaggcactgcagggcggccaatcagccggcggagagcgccgcgctcacggagtagtaaagcacgtagctaattagacggtgctgcccttgttgttcaataatatcgtctgtcgtcccgtacttcataacctgcgcggcgtgttagtagttgtttggtggtgtttggcgactggcactataaagaagggtcagatcgagtgatgtacttgctaccaataaaggtatacggtttgtgtgttc

SEQ ID NO: 8778 - DNA, 823 bp, Zea mays; identical to SEQ ID NO: 8137

SEQ ID NO: 8779 - DNA, 1426 bp, Zea mays
ccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgtt

SEQ ID NO: 8780 - DNA, 946 bp, Oryza sativa
gagtgtgtgtgactcgatccagcgtagtttcagttcgtgtgttggtgagtgattccagccaagtttgcgatggcttctcagcaggaacgggctagctaccacgccggcgagaccaaggcccgcgccgaggagaagacggggcgcatgatgggcacggcgcaggagaaggcgcgggaggccaaggacacggcgtccgacgccgcggggcgcgcgatgggcaggggacacggcgccaaggaggcgaccaaggagaaggcgtacgagaccaaggacgcgaccaaggagaaggcgtacgaggcaaaggacgcggcctccgacgccaccggccgcgccatggacaagggccgcggcgccgcgggcgccacgagggacaaggcgtacgatgccaaggacagggcggctgacacggcgcagtccgccgccgaccgcgcccgcgacggcgccgggcagaccgggagctacattggacagaccgccgaggccgccaagcagaaagcggccggcgccgcgcagtacgccaaggagaccgcgatcgccggcaaggacaagaccggcgccgtgctccagcaggcaggggagcaggtgaagagcgtggcggtgggggcgaaggacgcggtgatgtacacgctcgggatgtcaggcgataacaagaacaacgccgctgccggcaaggacaccagcacctacaagcctggaactgggagtgactaccagtaatacggtataagaagcatgtgtcgtctttggcactgatgccaaagtgtacgtgttgtatcctcttttttaagtttcagctcgacttcgacgtgttcggtgtcacactttggtttttcagttgtgctcaactgttcatgtttctggttccatggagggccagtgtggaggtcaatgtttaagctttcgttttaaaatctgataataaagttggttaagacctgaaagcgtt

SEQ ID NO: 8781 - DNA, 1514 bp, Oryza sativa
cagaagcccgtggaagcttcggaagcggcgcggcgcggcgctgggcgggggagaagaccagagcggcgaggaaggaggcggcgcccagcggggagagcgagcggctcgacgccgacggccatggcgctgctgatggatcccggggcgggaggccccctgacggagagcgagaaggccgacctggacgccatcgccgccatcaaggagtcggcggcggcagagtacaaggagaagggcaaccggctcgtcaagatgggccggagccactacgccgacgccgtcgactgctacaccaaggccattgcccagatggagccgctgccgccgccgccggtgccatcccccgacgcctccgtcctcttcgccaaccgcgcccacgtcaacctcctcctcggcaaccaccgccgcgccctcgacgacgccgcccgtgccgtccagctctctccctccaacgtcaaggcgtactaccgggcggcgaaagcggcgattgctctcggcttgctgccggaggcggcggccttctgccggcgggggatcgagcaggaccctgctaatgaggagctcaagaaattgctcgcacaagtggacgcccaacagagtgagcaagatcgtcatagggccaaggttgcgcaggccgtgtccgctgcgaaggatattgttgccgctatagagaagagggggttgaagcttgggaaggcagcatatcaagagcttaccggtgtaaagaagccgaagttggatgagcagggtgtgcttcactggccagttcttctgctctacccggaggtcatgtcgagtgacttcatcgaggattttccggagacagatactttcgtgccccaccttgatgtcatgttctcagaaagttctccaccattaccatgggatgataaacacgcttacacacgggatgctgttgagttatattatcaggctggcgttggcacagttctgtccaaaagtgaaatattgaaaattcttttggaaggcactatggactcaaagtcacttcctgaaagcctgcttgatgaggaagatggagaaaatgatgatggcaagagcagcacaattacatcatcagataagggttctgtgaagtggatcaatgtaaaagagggaaaaactcttcaagaagtgctgcagcataaagacttcatcatccctgcaattcctgtgttctttgttgtttcaagaaaatccaccttttacagaaagttcaaggcaggaaactggtctttgccgtaatgcttagcgtgattcagtttggcacatttggaagatgattagtgcggtacgcgtatgatcagagaagaaaagctggccacctagtcattcttgtatggttttatatgttgctttatagaatgatgaggtgtgttctttcctgtatttggtacaattctcaagtattttcctatcctttgcttgagatgctcagtatgccgtttctggagaaacacactgagaatgtacttatgtatggacagctttgggcctgatttagcgcttggcac

SEQ ID NO: 8782 - DNA, 853 bp, Oryza sativa
ggaccaggctagctaccgcgccggcgagaccaaggcccacaccgaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggttt

SEQ ID NO: 8783 - DNA, 613 bp, Oryza sativa
gctcctcaaacgagaccaagaaatcaatcgttccagcgaagaagaagaagaagaaggaggaatccatggcggcgaggacggtggcggtggcggcggcgctcgccgtgctgctgattttcgccgcctcgtcggcgaccgtggccatggccggccggccaacgcctacgacgtctctcgacgaggaagcggctcaggcggcggcgcagtcggagatcggcggcgggtgcaaggaaggggaaggggaggaggagtgcctcgcgaggaggacgctgacggcgcacaccgattacatctacacccagcagcatcacaactaattaatcttatcgatcaatcaataatcaatcaatcaatcagtcgcttcctcttcgatctaccaatactagtattggtatataattaaaactgcaaatccgtcatgcatgcatggtatgcccatcgatccatccatgattatctctagttagatgtagtaacaaactgcatgcgcgtgttgtgctcatcagtgttaattttggccgcccccctgttgataaacagttcttgatcgatgagagctagctttcgttttgttttgatttgttggttggttggttgatttgagagttgagac

SEQ ID NO: 8784 - DNA, 873 bp, Oryza sativa
aaatccagccaagaagatcgagaccggatacagctagcaatccatccaagaagatcgagagagcggatacagctagcctagctacgcgaaggatcagatcatcggcatggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttggggacgtgccatgggatgattttgcacgatctgtgaaacgcctgaagatactgggttaactgaactgaaggagatgcatgcgtgagttgatggagcacagctcggttttggttgcctggcatctgcgtgtgggtgtgcactgatgtatgtacatgttttcgttttcagtcaggatgttaggacgagagaaagagctttctgtcaaagactatatactgctagcttatatatactgtagttgggcacatctcatgtgtgcccagggctaggttttgag

SEQ ID NO: 8785 - DNA, 953 bp, Oryza sativa
gttcgatcaagataatcgagcaaaatccatcagagttctaacattcgcgcgtgaatttcgaggttaatttttgaagcttaggatcaatggcttcccaccaggaccaggctagctaccgcgccggcgagaccaaggcccacaccgaggagaaggcggggcaggtgatgggggcgagcaaggacaaggcgagcgaggcgaaggacagggcgtcggaggcggcggggcacgccgccggcaaggggcaggataccaaggaggcgacgaaggagaaggcgcaggcggcgaaggagagggcgtcggagacggcgcaggcggcgaaggacaagacctccagcacgtcgcaggcggcgagggacaaagccgccgagagcaaggaccagaccggcggcttcctcggcgagaagaccgagcaggccaagcagaaggccgccgagaccgctggcgccgccaagcagaagaccgccgagacggcgcagtacaccaaggactctgccatcgccggcaaggacaagaccggcagcgtcctccaacaggcgagtgagcaggtgaagagcacggtggtcggcgccaaggacgcggtgatgagcacgctggggatgaccgaagacgaggccggcaccgacgacggcgccaacaaggacacctctgccaccgccgccgccacggagacgacggcgagggatcactagacgccgtgaatgatttccctttgggtctatttatgtatgttttcacttcaaattcggtgcaagtttgaatttgtttttgtgtcgttttgagtctgtatcgatgctgtatgaagtggtggtcgtcgcaggggaggatttctgacgggtgtgggtgatgtgtactgatgatgttcagttgttttcgtcagagtttctcgtctgtgttctgtttattatggcgtaacaataataaaagtttgggcctaaagcccgcatttgtggttt

SEQ ID NO: 8786 - DNA, 802 bp, Oryza sativa
agggagcggcggcggcgaaggcgccgcacaagctgcataggcagtgggcgttctggtacgacatccagtccaagcccaagcccggcgccgcgtgggggacctcgctccgcaaggcctacaccttcgacaccgtcgaggagttctggggcttgtatgatcagattttccgtccaagcaaggtgacagtaaatgctgattttcatttattcaaggctggtgtagaaccaaagtgggaagacccagagtgtgcaaatgggggcaaatggactgtgccatgtagcaggaagaccacccttgagaacatgtggcttgaaacgctgatggctctgattggagagcagtttgatgaaagtgaggaaatttgtggagttgttgctagtgtccgccagagaggagacaagcttgcattgtggactaggactgccagcaatgaagccgttcaggtaaacattggcaagaaatggaaggagattgttgactacaatgataagatggtctacagcttccatgatgacgccaagagggagaaaccaagcagaggtggacggtacaacgtgtaagtcaccgcaaaacgttgcagcttggatagtggccatcgagtggtgtgccgataccggcgcctgttctttacagcctcagctagtgttgttgtccgaggcaatttttccgacctattgtgttgctttcctctctgatagcttatggtaaaagatacaaagatgttgaggagtttgtacgccacttaattttgctcgtaacatacattgacaatcaagaggagccatggcattgcgatctgctt

SEQ ID NO: 8787 - DNA, 1107 bp, Oryza sativa
aaaacctcgcaaaaccctcggccctcacccgccgccgccgccgtcgcctccaccggtaaacggcagcatgagtcggcaccctgaagtgaagtgggctcagaggattgacaaggtttacataactgtacaattagctgatgctaaggatgctaaggtcaatctggaaccagaaggtgtattctctttctctgctacagctggaactgatgggaacttatacgaatcaaagctagagttgaacgacaaagtaaatgttgaggagagcaaaataagtgtaggtgttaggtccatattctgtattgtagaaaaagctgaggccaaatggtggaagaagcttgttcgagatgatcaaaaggcaccacactttgtgaaagttgactgggacaaatgggttgatgaagatgatgatggtgctgatgtcaacgtggatggaatggacttttcgaattttggtggcatgggtggaatgggtggaatgggcggaatgggtgatatgatgggtggcatgggtggtatgggtggcatgggtggcatggctgagatgatgggtggcatgggtggtatgggcggtatgggtggcatgggtggcatggatgagttcgaggacgagagtgacgatgaagaagaagtgtctaaacctcaagacgcagagaaggctgctgaagccggaaaatcccaggagtcggacgctaaagccgagacaagttagagcaatcgaaggcccctctacataattcctttctctgttgcatcccgtcttttatggatctggtgaactgaagaaaacattttacgttatgacggtagggatgggtgctcccttgtagaacgatgctatgaaactggagctccaactgagtacgcaaaccattcttggattgtttttcttaatgcgctttgatgcttcatcgctctgcaatcatatattaagctttggatgctttaatctgcttttgtgagatactgctgtgcccgtgctagagtccactgagcatgcaacaattcatgtgatctgacgatgcttgtgctagacgagtgaggcagtagcactgttagttcccaagcttgttttgaaaggatgcatagtgaatccctatttatttgttt

SEQ ID NO: 8788 - DNA, 1541 bp, Zea mays
caaccgtcgagcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccgtacatcaacaactacatcctgctgagccagctggagcacggcctgctggcgcggcacgtgccgggcccagcgccggcgcgcgtggccttcgtcggctccggcccgctcccgctgagctccctggtgctcgcggcgcgccaccttccgggcgcctccttcgacaactacgacatctgcggggaggccaacgaccgggcgcggcgcctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccgaggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacgcgcacggcgccgtgctcagccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatccatccatccatccatccatctatagcagtattatgtatgcatccacatggtaataatctggctgaccgcatccgcatatggtcgtctcatcgtccatctataccttgaaagctactaattaattactgagttattattactactgtttttactactactacgtacaactacctcatctagctggtgtattaattgattttgtttgttactgctgtactactgttgttgtggagatgaaccatgcatggagtggttagtcactctttagtactttcatgacgttgttttcaacggtcatatcatcatcattgttgttt

SEQ ID NO: 8789 - DNA, 1502 bp, Zea mays
aagcaaaagcaaccgtcgagcttgcaacgccttacgcctccacactcaacagtcatggtcgtcatgggcaaggagcagcaacaacacgaggaggaggaggtgcaagggaaggtcgtccaagaagaagtgcaagtcgttcaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagcggctgggcccggagctgcaggagatgcgcggcgggctgatccgcctctgcgccgacgcggaggcgctgctggaggcgcactactccgacctgctggcctccttcgacaacccgctggagcacctgtcgctcttcccgtacatcaacaactacatcctgctgagccagctggagcacggcctgctggcgcggcacgtgccgggcccagcgccggcgcgcgtggccttcgtcggctccggcccgctcccgttgagctccctggtgctcgcggcgcgccaccttccgggcgcctccttcgacaactacgacatctgcggggaggccaacgaccgggcgcggcgcctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccgaggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgtgcacgcgcacggcgccgtgctcagccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatctatctcatctaatatccatccatccatccatccatctatagcagtattatgtatgcatccacatggtaataatctggctgaccgcatccgcatatggtcgtctcatcgtccatctataccttgaaagctactaattaattactgagttattattactactgtttttactactactacgtacaactacctcatctagctggtgtattaattgattttgtttgttactgctgtactactgttgttgtggagatgaaccatgcatggagtggttagtcactctttagt

SEQ ID NO: 8790 - DNA, 958 bp, Zea mays
gcgcctttgtgctgttctcctaatccaaaagtcgcgtgctgtgctctgctctcgcctcgcacggactcgtggtaaaggatggagaccatgtcggctctcgcgaggacggcgccgccccttgctgggaccattcgccggccgtcctgcgcgctgcggccgacggcgtccctctccttcgccgccgcttcaacgacgccccgcggccggctcgggctggggctgagcacggcgccggcggggagcgggagggcggccagggctcgcgccgtcccgcagcgcatcgtcgcctcctcggaggttgagcgaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagttgatcgattacataacttctggccctgttgtctgcatggcctgggagggtgctggtgttgttgcatcagctcgcaaattaataggagctactaacccccttcaagctgaaccagggactataaggggtgatcttgcagttcaaactggaaggaacgttgtccatggaagtgatagtcctgataatggcaagcgtgaaattgaactgtggttcaaagaaggcgagctctgccaatgggaatcagttcaagcaccgtggcttatagaataactcttgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagctaatttattgtcatattt

SEQ ID NO: 8791 - DNA, 1176 bp, Zea mays
cgctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 8792 - DNA, 1123 bp, Zea mays; identical to SEQ ID NO: 7525

SEQ ID NO: 8793 - DNA, 1065 bp, Zea mays
gagcctaccgccatgtcggcgaccgctacggacgaggccgcggtggaggcgcgcctccaggagctgcgggggaggctcgggaagaagcagcacttcgaggaggccgtaaacgagctcgccgccgccgtccgggaccgctacgccggcgcctcccccgccctccgcaaagcgatgtattcaacggtttgccgcgttgcaacagtgcttcaaaccagatatacagctccaggattctggcatgttggtctgaacctcttcgttggaatagagaagctggtaagtaatcctgctgaaaaggagcacctgaagacctgcatttcgagggcccgtgagcatcttgatgaaaaggaaaatgaggattctgtgccaagcaacagagaagcagacaccagatttctttttgaagggcaccttactgtgggacaggaacctccacctccagcatggcttgttgcccagaatttaacgagggaattgagcatactaactgaatcctctggtgatcaagatgggagcaacaacagaacagtgcctagagccgaggagattacacctgctataatgaacctcctagaaaccatatcaggcgacagggatctagaaactgctttggaagaatcactgcagggaatcattgagtatccacagagggcacccccggcttcaaaggaagttgtcgccaatcttcctgtcattgctgttaccgaggaagtcatgtctagattgggtagtgagacggagtgtgctgtctgccgcgaaaacttggttgtggatgacaagatgcaggagcttccctgcaagcatctcttccatcctctttgtctgaagccatggctggacgagaacaactcctgccctatctgccggcatgagctgaggacggacgaccatgtgtatgagagcaggaaggagcgtgaaagggaagaggaagaagatagaaggggtgcggcaaatgctgttaggggtggagaattcatttatatctgaactcaacagttccagaatgtaatccctttgatgaacttcgttattaccatgttgacatctatatatacctagttactt

SEQ ID NO: 8794 - DNA, 720 bp, Zea mays
cggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagg

SEQ ID NO: 8795 - DNA, 751 bp, Zea mays
attccctttcccaagaaaccaagaacccagcccctcaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttcttaatccagcgccaatgcatccacacatttacagcaacgggcacatctgcttagatattctgtatgactcatggtcaccagcgatgaccgtgagctctgtctgtatcagtatcctgtctatgctgtctagttcgccagcaaagcaacgcccggcggacaatgaccgctatgttaggaactgccgcaacgggaggtcgccaaaggagactagatggtggttccatgacgacacggtgtaatgatctccgtggcattgcctgtcagccttctgtactgtgaactgtgatatatctcttcaagggggagatgagatgatttaggcctatttctaagcagccctctattggattgcgaagcttaccttgctgtggtggtatgtaaatgagttgctcacatgtgtcagtctgggaatatgtgttatcaccatcaatgatataatatatagaataaagcaagattgtaccc

SEQ ID NO: 8796 - DNA, 1832 bp, Zea mays
gttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctacactggcctgtcagttatcttttgcatgcatatgcattatcatatacgcagtcgcgtagcaggtttccttatggttatcgcttgagctgagggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 8797 - DNA, 825 bp, Zea mays; identical to SEQ ID NO: 7336

SEQ ID NO: 8798 - DNA, 1612 bp, Zea mays
gccccgcatggcaccccaggggcggagagcgacgaggagatacggcggggtgccagagatgggcggcgcgtcggcgtcggcctcgtcgggcgccggcgcggacgagcgtcccaagggggaggacggcaagcaggggcaggtggcggcgggggcgcagcctccagcgggcgggaagaagcgcgggcgcacggcgggggacaaggagcagaaccggctgaagcggctgctgcggaaccacgtgtccgcgcagcaagcgcgagagcggaagaaggcgtacctgacggagctggaggcgaaggccaagggtctggagctccgcaatgcggagctggagcagcgggtgtccacgctccaaaacgagaacaacacgctccgccaggttatagatgttagtggaaaagaattcaaattcacctgggcatctggacgtggcgaattgtgtgatatttatgaagaacgtcagagtggagaggatggaaatgggttgcttctggagtgtggctctacttggcgcaagtgaaccctatagcctgggcagttcctacaaaacatgagggtgatgccagtgaagaagcttctctcgccgatgagacacttgcatcagaagtagtgctaacccggaagaggaaaataggaagctctttgtcagtagagccaaaccatctctctgatgaacttgaaccaaagttggaggatgcttagaacggggagacgtctaactgaaaagtaaaagtgggcagcatcgtgatgccaacttacccccctgccatggttttattggtcctctgcttgtttctcgttttccttgggagtcagcttctctgttttatgtggtcgcacacggccttatttgtagtattacaccacagaagctggctgacccccactgagggagaggtgattgatgcaagcattgtgtatgatccttggacaagggaatcgcgggggtttggttttgtcaccatggctgctactaaggaggcagatcactgcatcaaatatctggattgttctgtgttgcaagtactctacacagaacattttattgttttgtcttcaccaccgagaatccgagatcgcctcccatagcctccacatccataaggtcctgcttgactgcgacgacgtccaggctgatgccctcatcgtggatcgactcgcctcgctctagaaggagtggcccctctggagttgaatatgcagttataaccaatttttaccccttttatcctagaagagttgccaagacacggtataagaccatgataatagactaagagaggatttggctctaattactatatgttttatttatgcagtcccatgagaactttgagtatttgcagattgctttattaatttattaaagttaaagattgtatgtgttgagtatgtatccactcttgttggaagtgtcttgcaattccaatccaaggatgtataaaatactgcatgggctaagtatgtgttttttcatgtatttggagtatatatactttttgttgcttgagaacatgtatgtacactagaagcttgtcaattgtgtgaacttgagttgatccctgtctaacctgagtatatatatatatatatatatattttgttgcttgag

SEQ ID NO: 8799 - DNA, 1209 bp, Zea mays
cacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccaggg

SEQ ID NO: 8800 - DNA, 555 bp, Zea mays
caccttggacatatatatggaaaatagcttcacagtctagattccatggcatcaaggatggggatggtggctattctgtccttgtttgtttgtgctcttgttgcttcaacatctgtcaatgctaatgtgtggcagactgatgaggatgctttttatagtacaaataaactgggagtcaatggcaacatggagatggcacaacaacaaggtggatttattggccatcgcccaagacttgcattattcaatagggcatcaaaacaactggaccgtgaaaaaagacctgtgcctagcgggccagaccccatacatcacagcatcccatcacatgctcctcagcatccaccatcatatggcaaagctccttatgaagatgacaagagcatagcatctcctggtctgtccaacccgataggtcctccaccatttttagatagatactagttcatgcaaaagtagtgagtatttatgcacctatgccaatgaataacctctaattacctacatgtattggcctggtgtttggtaacatgaagcaataactttctcttatcg

SEQ ID NO: 8801 - DNA, 712 bp, Zea mays
gcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttctggagctggctgggaacgctagcaaggatctgaaggtgaagcgtatcacccctcgccacctacagttggccattcgcggagacgaggagctggacaccctcatcaagggcaccatcgcaggtggaggtgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacattgtgtttgtgttgagttgttaacttcaagggtgcaaacctggataattatttagttattatatgactatctggtattcggttt

SEQ ID NO: 8802 - DNA, 1337 bp, Zea mays
caagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacg

SEQ ID NO: 8803 - DNA, 1427 bp, Zea mays
cccttcccaacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgtt

SEQ ID NO: 8804 - DNA, 1297 bp, Zea mays
acctcgtcgcttccgctccacaggatcctctgcgccacccacaaccgtgcgaccgtccgtgctgccggcgaccccgatccgccgacccgtcccgtcccaccacaccctaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctatccgtggaggagcgcaacctgctgtccgtcgcctacaagaacgtcatcggcgcccgcagggcctcgtggcggatcatctcctccatcgagcagaaggaggagggccgcgggaacgaggcgcacgccgcctccatccgcgcctaccgctccaagatcgagaccgagctcgcccgcatctgcgatggcatcctcgccctgctcgactcccacctcgtcccatccgccggcggcgccgagtccaaggtcttctacctcaagatgaagggtgactaccacaggtaccttgctgagttcaagtctggtgcagagaggaaggatgctgcggagagcaccatgaatgcctacaaagctgctcaggacattgctcttgcagatctggctccaacccaccccatcaggcttggcctcgctctcaacttctcagtgttctactacgagatcctgaactcccctgatcgcgcctgcaaccttgcaaaacaggccttcgatgaggcgatctctgagctagacagcctgggagaggagtcctacaaggacagcactctgatcatgcagctcctgcgcgacaacttgaccctatggacttccgacaccaacgaggatggcggcgacgagatcaaggatgctgctgccccgaaagaatccgcggagggtcagtaagatggattcagtctcacgacctgctgctgctgatgttgaggagtgaccagaaccagaaccgccgtcctcgattctgatagattatcttctagtataccttgtgttgttgctgttgttgtcgtcgtcgcgccggtgtatgcgatgaagctgccattgctgctgttttaattaagcattctagatgttataccgcatgctttgtttcggtttctatgtcgataaatggtggccggatgctggttttcgtgctccgagccggccaccaggaagaagacctgcctgcccttgtgggtgcagcgttgttagaatgacctacggtgtatttgactttgacaggcctgctgcctagtggactgatattctgttatgcgc

SEQ ID NO: 8805 - DNA, 1631 bp, Zea mays
cgtctctctcctccgctcctcctccatcatagctcctggctcgcggctcagcttgccactaccagcaagcgctcgtcacccgtcggttctccccgagtagctcgtcgcgtcggcaatggagaatctgagatctcaaaactgccaccaaggtgttgccatggagggagtcaagtttgcgccggagaaggccaacaccaaccggagagccctcagcgacatcaagaacataataggaggcccacaccagcacttggcggtcagcaagagggctctgtcagaaaaaccagctgctgctgctgctgcaaatgctaaagatcaagctggctttgttggacaccgtccagtcaccaggaaattcgctgcaacattggcaacccaacctacagttgcccttctggacccaattggaagtgaaagactgaaaagaaacgctgatacggcatttcacacacctgcagatatggaaagcacaaaaatgacagatgacagtcccttgcctatggtgtcggagatggatgaaatgatgagtcctgaactgaaagagatcgagatggaagatattgaggaggcagcacctgatattgacagtggtgatgcaggaaattctctggctgtggctgactatgtagatgaaatttacagattttacaggaaaactgagggtgcaagctgcgtccctacaaattatatgtcaagccaaactgatataaatgagaagatgcgtggcattctaattgactggctcatagaggtacactacaaactagagctgttggaggagacccttttcctaaccgtgaacatcatagacagattcttggcacgtgaaaatgtggtgcggaagaagcttcagttagctggtgtaactgctatgttgctcgcgtgcaagtatgaagaagtgagcgtacctgtggtcgaggatctgatcttgatctgtgatcgtgcatacacaagggctgacattcttgagatggagaggaggatagtgaacacacttaatttcaatatgtcggtgccgactccatactgtttcatgagaaggtttctaaaggcagcacaatcagagaagaagctcgaactcctgtctttcttcatgatcgagttgagtcttgtcgaatatgagatgctccagttctgcccgtctatgctagcagccgctgccatctacaccgctcaatgcaccataaatgggttcaagtcctggaacaaatgctgtgaactgcacacaagatattcagaagaacatctaatggtttgctctaggatgatggttgaactgcaccaaagagcagctcatgggaaacttacaggggtccatagaaagtacaacacttctagatatagctatgctgcgaaatcggaacccgcaactttcttgctggatgcctgaacctaagcttgaactatacacactcttaactacttccatggaaagagtggaagggaggctgcttcgactaaactacagaagtgggatctatctgaatatatgcaacggctgttgcagcaaatatttggtggggctgggttggtgtgttgtttgttagttcaataacttaacattaatgaaacagtgtttgtgttgtttaggttttttttccaattatatcgattggaatttcatttgttgt

SEQ ID NO: 8806 - DNA, 1170 bp, Zea mays
acaccgcaaccgcaagcaagcgaagcgcagagcctgcctgaccagagctagctgagtgcaacagccaacagcagctggtctgactgacatggcgaaggacatcgaggcatcggggcccgaggcgggcgagttctcggccaaggactacaccgaccctccgccggcgccgctggtcgacgcggaggagctcacccagtggtccctgtaccgcgcggtcatcgccgagttcatcgccacgctgctcttcctctacatcaccgtggccaccgtgatcgggtacaagcaccagacggacgcgtcggcgtcgggccccgacgcggcgtgcggcggcgtcggcatcctcggcatcgcgtgggccttcggcggcatgatcttcatcctcgtctactgcaccgccggcatctcaggtgggcacatcaacccggccgtgaccttcggcctgttcctggccaggaaggtgtccctcgtccgcgcgctgctctacatcgtggcgcagtgcctgggcgccatctgcggcgtgggcctcgtcaagggcttccagagcgcctactacgtgcgctacggcggcggcgccaacgagctcagcgacggctactccaagggcaccggcctcgccgccgagatcatcggcacgttcgtgctcgtctacaccgtcttctccgccaccgaccccaagcgcagtgcccgtgactcccacgttccggtgctagctcctctcccaattgggttcgccgtgttcatggtgcacctggccaccatccccatcaccggcaccggcatcaacccggcgaggagcctgggagccgcggtcatctacaacaaggacaaggcctgggacgaccaatggatcttctgggtgggtccactgattggcgccgccatcgccgccgcctaccaccagtacgtgctgagggccagcgccaccaagctcgggtcctaccggagcaacgcctaagttccgcccggacgcgccaggagctgggcaccgttccaattctgttcctccacatgacgccctgttctgtttccgtgtggccaggactccgcttgctcgctgctgttttctacttcggaccaaagtgtgatatatcgttgctttctgtatatgtatgtaggaatgcatcatgtaacgagaatttggaatacaattgcgtgagtttttatccgatc

SEQ ID NO: 8807 - DNA, 1570 bp, Zea mays
gtgagctagctagctctagctaggccacgcactgctgcctccttcatcatcaggtcgtgctagctagctagctatagctgggccgggggacgtacgacatcagcgcgcggccatgggcgtggggaagctgatgaacgacgtgaagccatacctggcgatggtgctgctgcaggtggggttctccgggatgtacatcgtctccgtcgcctccctcaagcgcggcatgaaccacttcgtcctcgtcgtctaccgcaacctcgtcgccaccgtcgtcatggcccccttcgccctcctcttcgagaggcgagtgaggcccaagatgacgccgctcatcttcctcaagatcatggggctcgccgtgctcgagcctgtgctcgaccagaacatgtactacctcggcgcgaagctgacgtccgcgaccttcgcctcggcgctggtcaacatcctccccgccatcacgttcctgctggccctcgccctgaggatggagaggctgaggctccggagcctccgcagccaggccaaggtggtcggcacggtctgcaccgtcgccggcgccgtgctgatgatcctctaccacggcccggtggtgccgttcccgtggtccgcgggtcgtcttcaccaccacgtccccgcggcggcggtggagagccagagcagcgcctcctggctcaacggcatctgcatgatcatcggcagctgcctgtgctggtccggcttcttcatcctccagtcgaacacgctgcagagctaccctgcggagctgacgctgacgactctgatctgcttcctgggctcggtgctgaccggcggcgtggcgctcgtggcggagcgccgcgacatgagcgcctgggtcattggcttcgacacccgcctcttcaccgccgtctactccgggatcgtgtgctccggcgtggccttctacgtgcaggggatcgtgacgcaggcgcgcgggccggtgttcgtgacggcgttccagcccctgtgcatgatcatcaccacggttcttggctccaccatactgaaagaggagaccaccctgggaagcgtgattggcgcggcgatcatagtggtggggctctactgcctcatctggggcaagagcaaggaccacctcggcagcaacggcggcaagcccggcgccgcggccgtcgccgagctgcccctgacctcgtcggctcctgcttggtccaacggcaagcaagctctggccgtcgtcgagacgacaccgccttcgtctttgcccaacaagtgcgttcactgacgcgcggatcggagctccatgcatgatgcggaccgtacaccaccgcacactactagtagtgcattgccagtgactgtaagccgccggccgtgtatgatcatgcatgcataccgtcataccgatatgatgtcccatactcccatcgttgcgtttaacactctcgagtttttgataacgtacttgcgtgtgctctgctgtgtgccactgccagtgccaccacaaccaatagtctaatactactacgacaattaagctttgtttagtttgtgcaaggaaagaagagaattaattactactattcgagtc

SEQ ID NO: 8808 - DNA, 856 bp, Zea mays
tcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgagacgtgttgatgaact

SEQ ID NO: 8809 - DNA, 820 bp, Zea mays
cttctcctccccctccggttcgggttcgggttcgtgaggttctccggggttcggtttcgtgggtgggcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 8810 - DNA, 2048 bp, Zea mays
aacaacctcggcttctacgactacccgtaggagtcgaagtcgactggcgtagcgtaggaggcggcggttccaggcgaccatccaataatcgccaccctcacgcgagaaatccccggcaacttttggggaactacacgtgtatggagttttattagtattccaggggcatcacaatggcatactttcctgatgaagtagtagggtatatccttggttatgtaacgtcgcatcaggaccgcaacgcggtgtccttggtctgccgggcatggtacgacattgagcgtcatggccgccattcggtgcttgtaagaaactgttatgcggtgtgcccagagcgtgtacatatgcggtttcccaacatgcgcgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcgtgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcaaggcccttgcggccaccatgccaaacatcaatgtcgaggtcatcggtggggcgagctttggtgcgatggatggtggtgtcagcggtgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccatttt

SEQ ID NO: 8811 - DNA, 1610 bp, Zea mays
ggctcccactagaaaagcacacccaccttctctctcttcaccagcctgtccccaacaggccaacaatgcacaccaacatccactctctcgtcaggctcctctcccccaaaaatgagcgctgagttctgcgctgctgccggtgtcgtggccatggagctcggagtcggagatgtgctggggctgcagcaaggcatcgcaatcaccgcgccatcgcccagggacagcgacctgggtcttctcaagcgagcaggcctcacccaggctgcggctgctgccccctacccctcccccttccttgacgaggagaagatgctcaggttctccaaggcggctcacacattgcactcaggcttggattttggaggcccaggtgagcaggctttcctgctgtccaggaccaagatgccatttactccctcgcagtggatggagctggagcaccaggctctgatatacaagtacctcaatgcaaaggcccccataccttccagcctgctcatttcaatcagcaagagcttcagatcatccaatagagtgagctggaggcctctgtatcaaggctacacaatgcagactctgacccagaacctgggagatgccgacggacggatggaaagaagtggcggtgctccaaggaagcaatggctgatcacaagtactgtgagcggcacatcaacagaaaccgtcaacgttcaagaaagcctgtggaaaatcaacctaagaagaccaccaaggaggtgcctgctgctgctggctcattgccatgtgctgggccacaaggtagcttgaagaaggcaaaagttaatgactccaagccaggcattgtcagctattgggcagatagtttaaacaggacaatgttgagcagagagaaagcaaacaaaccgacggaagatagctctttgctgcttacttctacgaacagccaacccaccttgtccctgctctctcagctaaagcagcaaaataaaccagataagttaggccccacactggaaaatgagtcaaacccagacacaatattgaaagcctggggtggcaaccagcctagccacaagagcatttcctctacagagcgccatgatgctgaatccctccaatcagtccttcaaaatttcagcctagcccagaatgagaagatggagtcagaaaagaacaaatattctgattccgtgctagtttcatcgactttctattctgcagacggtccacgagctacctgccttacacctaacatgacacaggtgaagcaggattgcatatcaagctcttgggagatgcctcaaggtggacctctaggcgaaatcttaacgaactccaagaatagcgaggacttaagcaagtgtaaaccaaggtcatatggttggttgttgaatcttgaccatgcaccatgattcctcaatccatgaagagcttgacatagatatcccatcatgtaggcaaacaatggtcagaaaaaggttatgaccacattgcttgccccatgcatgcttgctatctacatttgtatttctgttacgtagcatttagctagttgaattatcagttcttctggatatggctgtatcttaaacaagttctagtttgtgtcagatgatatcttgctcgct

SEQ ID NO: 8812 - DNA, 1139 bp, Zea mays
gcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcct

SEQ ID NO: 8813 - DNA, 1135 bp, Zea mays
ccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttac

SEQ ID NO: 8814 - DNA, 2079 bp, Zea mays
tttttttttttttttttttttttgacagtcttcatatgtaattttgatcaccgtgaagagtatatattgcagtcattgtgccatggcacagtctataatacagacaattatcaaaagtggcgagactacaaattaaatccttccaccacaggatcaagttaggttaaatatagccctacaggaggcgctataggggaacataccaatgaacatcatccctgctgacataagggcatggttgaaagatagggccagatgaggcatttatgcaaacaggcctccgtctagcaatgggaactccacggtttcactgctaaactctacatcatcatcataccaattattctgcagtccaggtattaacattgtatcattgcactgatataaatcgatgctgttcaatcctttattcccgaaggagacaccttgaagttgatagccggacaggtcttcaggtagacaagtaaaatcagtgccgcataatatacttgcctcttctgaagtaaacaaaatagctccgttcctttcctgatcaaagtcacaatctttaatgctggacaacccctccacgctggaaaacttccggtcactgttagttgaggtcacaacactgtcactaagttgagcagaaaccgactcaactgtacatgtcagtgctggtgataaggacttcatacagccaagaagatctggttttacatctgagaagtctctgacatctttctccacattgtaactcatcgaaattactggcggtggggcatacagatgaccaggggcaattgggtgctccaagtccggtttaggcaagcaagaatagtctcctagaaggtcgcagcgctcatggttatgctttggatactgcatgaactgctttggtggcacacttccactccaggactcacattccaagatcatggtttctgatagcttcctgtcctgattcactggcattctttcaaaagagaacaccccacttaaaggtgaagcagtggtgatattgtgagggtcaacagcatcacttgctgaaattccatttttatctggcaccttcaagggcattgaagtcttcgtgtcgtccagatgaggatcgagaatgttggtctgagcttcgaccttctgagaactatgctgacatccattggaaaggttgcctggttgctcttggaaggaacttcggaggttaagatgatccgatggtcccttttgattgaaatcttgcctagcagcacccattatcctttcctcgttctgcttttgcaacctactcaagtagaggcggtatttctgaagatgactggccacattctctcttgtcaggccaggaacattcataagatccagtattttcttcggcccgactttgtcaaatccaatttggttgacagcatttacaaatttctggtgaaggtcaacagaccagacaactctagccttcttaacagtagctccatcacttgagtcctgatctgcatggtccttattcacgtcttttctcttcctcatagtatcagagtcagctctcataaataggtccctctcgtcgaatccctctacaccatttctaaacatttggagatcatcatagctgtcattaccttcaatctctttcacctcatgcatttttttcctatacacatgttgccaaatgtttcggagttccttcatccgaacaggcttgaggaggtagtcacatgcaccatgctggacacctttcatcaccctacttgtctctccgtctatggacatcattataacaggtagatccatctcaagcccaatgagttcgagaagcttgaaaccatccatgtcaggcatgttgacatcactgattacaatgtcaaacttgtttctcctctcccggagaatttggatagcaacactggctaaaccgcatgtggtgacttcgtatgaacacttgcggagcatcttctcgaggatcttgagccaggtggggtcgtcgtcgacgacgaggacccgcaggccgtaggggaacgcggtggcgtcggtcagggccatggcgccgctagcgcgctagcccctccgcgcctcgcgctcgcaggcgggggagggcgaagg

SEQ ID NO: 8815 - DNA, 1357 bp, Zea mays
cgagcaacagagcagaagcaaagcgcagagctagcaagtgaccgaccgagagcaaataggcaaggcaacgcaggcaagatggtgcagcaagccgcgaaggaggtgatcccgctgctgacgccttacaagatggggcagttcgagctctctcaccgggtggtgctggcgccgctgacgaggtgccgctcctacggcaacgtgccgcagccacacgccgccgtgtactactcgcaacgcgccaccaggggtggcctgctcatcgcggaggccacgggggtgtcggccaccgcgcaggggttcccggagtctcctggcatctggacgcaggagcaggtcgaggcgtggaagcccatcgtcgacgccgtccaccgcaagggcgccatcttcgtctgccagatctggcatgtgggcagggtctccaccaacgagctccagcccaacggcgacgcgcctatctcgagcacggacaagcagatctcccccgacgccaagtccggaacggcgtactcgaagccgcgccggctgcggaccgacgaggtccccgggatcgtcgacgacttcaggcgggccgcacggaacgcgatccaggctggtttcgacgccgtcgagatccacggcgcgcacgggtacctcctggagcagttcatgaaggacagctgcaacgaccgcacggaccagtacggcggcagcctggagaaccggtgccgtctcgccgtggaggtcgtggacgccgtcgtccgcgaggtgggcgcgcgccgcgtcggcatcaggctgtcgcccttcgtcgacttcgtggactgcgtggactcggacccggtggcgctcggccactacatggtgcagcagctcaacaggcatagcggcttgctctactgccacatggtggagccccgcattaccgcccacgggcgcaggcagatccctcacgggctcttgccgttccgaaaggcgtttcatggaacgttcatcgccgccggtgggtacgatcgggaggaaggcaacaaggtggtggcagaagggtatgctgacctcgtcgcgtatgggaagctgttcttggctaacccggacctgcctaggaggttcgagctggatgtggcactcaacaaatacgaccgctccaccttctacacgcaagatcctattgttggctacacagattaccctttctttgaagaagaagatggcaagaatgagaggtgaaatctgataatgtggagggttcatcaagtataagttcgtcattatttccaccattcattattggtcattgtggtggagtcattgtgtcatgttgtttcattctgtactagtgtggtgtgaagtgaaataaatctatttggtgaaattgttataaaat

SEQ ID NO: 8816 - DNA, 825 bp, Zea mays; identical to SEQ ID NO: 7336

SEQ ID NO: 8817 - DNA, 925 bp, Zea mays
cgcagcctccaggcgttcggcgacgtcgccttcgcctactcctactccctcatcctgatcgagatccaggacaccatccgggcgccgccgccgtcggagtcgacggtgatgaagcgcgccacggtggtgagcgtggcggtcaccacgctcttctacatgctgtgcggctgcatggggtacgcggcgttcggcgacggcgcgcccgggaacctcctcacgggcttcggcttctacgagcccttctggctcctggacgtggccaacgccgccatcgtggtccacctggtcggcgcctaccaggtctactgccagccgctgttcgccttcgtggagaagtgggccgcgcagcggtggccggactcggcgtacatcaccggggaggtcgaggtcccgctcccgctcccggcgagccggcggcggtgctgcaaggtgaacctgttccgggcgacgtggcggacggcgttcgtcgtggccacgacggtcgtgtccatgctgctgcccttcttcaacgacgtggtgggcttcctgggcgcgctcggcttctggccgctcaccgtctacttccccgtcgagatgtacgtggtgcagaagaaggtgccgcggtggagctcccggtgggtgtgcctgcagatgctcagcctcggctgcctcgtcatctccatcgccgccgcagccgggtccatcgccggcatcgcgtccgacctcaaagtctaccgcccgttcaagtcctactgatcagattcacggcctacgggagacgcagcagcatgtggtatataggcatatactagcaaccatgttcgtgagttgcaactcataagtacttaaatcagactctgcatcattgctaaacgcgagtttttttaacttgtatacgcatgattcatgagtcccaattacatatgaaaaggatgcaacacaatat

SEQ ID NO: 8818 - DNA, 1098 bp, Zea mays
gccgccggtagcgggccggtcacttaccgggagggagaggtgctttggttcctggatgagctgtgaaggaactgggagcaagaagaattgatgtttactccgcagggcaaaggatggaccggctggtcgacgccaactccggccaaccagcggagcggtggtggggctcctgctgcgtcggcgccccttggaaagggcaaaggaagggtcgccgagctcgagcaggagttgcatgaatatcagtacaatatggggcttcttttgattgaaaagaaagaatgggcagcaaaatttgaagaaatcagtgaagtgctgacacagaaagaggagatactgaagagggagcaggcggcacatctgaatgctatatcagagtatgaaaggcgggaggagaacatgcggaaagcactaggtgttgagaagcaatgtgtcgctgatcttgaaaaagccttgcgtgatatacgagcagagatagctgaggttaaatttacatctgagaaaaagataacagatgctcagtctcttgaggctagtttggaggaaaaatccttggagatcgagggaaaacttcatgctgcagatgccaaacttgcagaggcaaaccgcaagaagtctcaagctgaccgtgatttagaagaggcggaagctcgtcaacgtagactggagaaggagaaactgtattttgagacagagcggaaggcccgagaaaagcaacttaaggagcaggaggaatcactgcaggaatgggagaaaaagctgaaggaaagtcagaatagacttaatgagttgcagagatctataaatgagcgagaggagagagcaaataagaatgatcaacttttcaagataaaacaggacgaactggaggaggcacgaaggacagtggaggccgctaaagttactctgaaagtcaaagaggatgatattaacaaaagactaaatgaattacatttacaggaaaaggaaaatgagttaaataagaaaatagattttgtggaaaataaactccgacatgcaattgagttgaatgagtccaagattgagaagttattattggagaaaagggaggtgcagatggaaagagaattactgctggag

SEQ ID NO: 8819 - DNA, 791 bp, Zea mays
gaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaaggaaaaaaatggtgcttcttggtgctgc

SEQ ID NO: 8820 - DNA, 1304 bp, Zea mays
ctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacggcgtccccttccgccgcctcaccggccactcccacttcgtccaggacgtcgtccttagttccgacggccagttcgcactctctggctcctgggacggcgagctccgcctttgggacctctccaccggcctcaccacccgccgcttcgtcggccacgagaaggacgtcatctccgtcgccttctccgtcgacaaccgccagatcgtctccgcgtcccgcgacaagaccatcaagctctggaacactctcggcgagtgcaagtacaccatcggcggcgacctcggcggcggcgagggccacaacgggtgggtctcctgcgttaggttctccccaaacaccttccagcccaccattgtctccggatcctgggaccgcaccgtcaaggtctggaaccttaccaactgcaagctgcgctgcactctggatgggcacggtggctatgttaacgccgtcgctgtgagccccgacgggtcgctgtgcgcctccggcgggaaggacggtgttactctgctgtgggatttggctgaggggaagaggctgtactcgctggacgcgggctctatcatccactctctctgcttctcacccaaccgctactggctctgcgctgcgacgcaggactctgtcaagatctgggacctcgagtcgaagcacgttgtgcaggacctcaagcccgacatccaggtctccaagaaccagatcctgtactgtacaagcttgagctggagtgcggacggaagcaccctctacactggctacaccgatgggtctatcagggtttggaagatctccgggtacggctacgcaggctagatgttgaaatcagcttggtctaggcagtctttcgggggaaaacattgtaatgtttgtcaagtttttgatgtcgtgagctatattgtctcttcgctactttccggtcgcccaaccattttaatcttactatggaagaatcttgttttgcactatgattcggttttattacttgtactttatattatgttatgtgcttcggccatgcaaccaattgaacgactgcggcggaaagacgttctggtttggct

SEQ ID NO: 8821 - DNA, 1478 bp, Zea mays
cgctttcgaaccgcactcgccctcctctgttctcttctctccctcctatagttggcttctcgccaccctctgctttcgatcagctttctccgctccccgtttccctctccaactccaatccatggcctccacggatcgctccacgccagcggaggacgagcaacagcagaagcgcccgtctctcttctcgccgtaccagatgccccgcttccgcctcgcccaccgggtggtgctggcgccgatgaccaggtgcagggcgcccgacgcggtcccaggccccgcgctcgcggagtactacgcgcagcggtccacggagggcggcttgctcatctccgagggcaccatcatctcgccgtccggccctgggttccctcgtgtccctggaatatacaatcaagaacagactgatgcatggagaaaggtggttgatgctgttcatgccaagggagctatctttttctgccaactatggcatgtaggccgagcttctcaccaagtatatcagccgggtgctgctgctccgatatcctcaactgataagccaatatcatcaagatggaggatactgatgcccgatggatcctatggcaagtatccaactccgaggcgcctagccacatccgagataccagaaattgttgagcaataccgtcaagcagccataaacgccatcaaagcaggtttcgatggcatcgagatccatggcgcccatggctacctcatcgatcagttcctcaagggcggtatcaacgaccggactgacgagtacggtggctcactctccaaccgttgccggttcctcctggaggtgacccgagccgtggtctctgcgataggggcagaccgcgtcgcggtccgagtgtccccggccatcgaccatctcgacgcctacgactccaacccactgcagctcggcatggccgtggtggagcgtctcaacgctctccagcaggaggccgggcggctggcctacctccacgtgacgcagccacggtacacggcgtacgggcagacagagtctggccagcacgggagtgccgaggaggagagccggctgatgcgtgccgtgcgaggtgcctaccgtggcacgttcatgtgcagcggtgggtacacgcgggagctcggggtcgaggccatcgagtccggggacgctgacctggtgttctacgggcggctgttcatcgctaatcccgacctggtggagcggtttcggcgcgacgccccgctgaacaaatacgtgcgcaagacgttctacacgccggaccctgtcgtcggttacacggactacacattcctcggccagcctaaggcgcgcatgtgattattagtaggttgccgtaattataagaggcggagtgttgtttgtgtgttgtgacttgagaaaacaagcaaacatctgggtaatgccgcgattgttacgtgttcctactgtatacgtgttaccaatattcgggcctacagattgtatcttgataatc

SEQ ID NO: 8822 - DNA, 709 bp, Zea mays
gacccattggtcgtcggcaatgttgtgggagatattgtggatcccttcatcacaacggcgtcactgagagtgttctacaacaataaggagatgacaaatggttctgatcttaagccatctcaagtgatgaatgaaccaagggtccacgtcggtgggcgtgacatgaggactctttacacacttgtcatggtggacccagatgcaccaagccccagtaaccctacaaaaagagagaaccttcactggttggtgacagacattccagagacaactgatgccagtttcgggaacgaaatagttccgtacgagagcccacgtccaatcgccggaatccatcgcttcgcattcgtcctgttcaggcagtcagtgaggcagaccacctatgcgccgggatggagatcaaacttcaacactagagacttcgcagccatctacggccttggctcccctgtcgctgcagtgtacttcaactgccagagagagaacggatgtggtggaagaaggtacataaggtgatatatcaaccaagcataacaacaaattggagtgaaaaaaatatatatcatgtgtgtggtgaacattgcaagtacgatgttcacaatcataagagccattattggatcacatattattctaatgtaatgtggctggggcgttctattggaaaaatagccacggtttgagatttacatataaatttgtgttaacg

SEQ ID NO: 8823 - DNA, 1453 bp, Zea mays
catcctccttgaagcgaaaacgatcgagcttgtatcgcaggcatttcggtacactacgttctccggctgtgtagagcttctgcggagatgggtgccgagttgggagaagcgggtgtccctgcccgggacatggtggacgcgctggaaggcgtgcgctccatcctgctgaaaccgtcggagcgcctcgacgacaagcgcttcacgaggatcgccggcgccgacttcgacgacgccggcctcggcctcgccgggttgctcggctcgctcgcgtccacggggttccaggcctccaacctcggcgacgccatcgacgtcgtcaaccagatgttggactggaggttgtcccacgagaagccaagcgacgactgcgctgaagctgaactcgatcctgcgtacagagaatccgtcaagtgcaagatattcctggggttcacttcgaaccttgtgtcttccggtgttcgggagatcatccggtttcttgttcagcatcgcatggtggacgttattgttacgactgctgggggtatagaggaggacctcatcaaatgccttgcgccaacctacagaggcgacttcactctgcccggagcgctgctgcggtccagaggacttaaccggataggaaacctgctggtgcccaatgacaactactgcaagttcgagcactggatcatgccgatcctcgacaagatgctgctggaacagtccacccaaaatgtttggacgccgtccaaggtgattgctcgccttggcaaggaaataaatgacgaaagctcctacctttattgggcgtacaagaacaacatccctgtgttctgcccagcattgactgacggatcaattggggacatgctgttctgtcactcggttcacagtccaggtcttgttgtcgacattgtacaagatgtacggctgatgaacgcggaaaccatccacgcaagcccaaggaagacagggattatactccttggcggaggccttccgaagcatcatatatgcaacgccaatatgctgcgcgacggagctgactatgcggtgtatgtcaacacagctcaggagttcgatggcagtgattccggggcgcggcctgacgaagcggtttcatggggaaagatcaagagctcagcgagaactgtgaaggtgcattgtgatgcgacgattgcctttccacttcttgtggctgcaacatttgcacgcaaggttcacggcactaaatcaacaaactgaatcggaggcagtgaaattaaaatatggcgctctataactagctgaaactttcctcatatgatggttgagcttgaagcatgaacttttatttgcttgaagggtgtctatctcttagctcgtttactatttatacattactgtaacatatgtatgatatatattcatttgaaaccatttgggttattatcatacaataaaacttgtgtgtacgagaacatttgtgacc

SEQ ID NO: 8824 - DNA, 1379 bp, Zea mays
acgcgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggc

SEQ ID NO: 8825 - DNA, 995 bp, Zea mays
gcgaccacaccgttcctccgagcccaggagcagccccgcgccaggaggaagtttgttcttttaacaatatgtcgagggaggagaatgtttacatggccaagttggctgagcaggctgaaagaatgtgattggggctcgccgcgcttcatggcgcattgtttcttccattgaacaaaaggaggagtcccgtaagaacgaggagcatgtgaatcttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgcccagaaaggcgatgcaggcgagggacagtaatcttcggagggggtgcaaagttgttcgagccccaatgttttagatgctctatgctgtcgaagttgtgctgtgccattattgtagctgatttcgtctccattcacttctttttccttgttagtaggctggtattggtcgaattagtaccccattgctttgtgttgccgctagtccatgtggactggtattgttcccctggatttatttggcaagcgtgtccgtgctcgctctagcgttttattgagcttttaaagtc

SEQ ID NO: 8826 - DNA, 800 bp, Zea mays
gctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 8827 - DNA, 925 bp, Zea mays; identical to SEQ ID NO: 8817

SEQ ID NO: 8828 - DNA, 960 bp, Zea mays
tcgatccctgcgctgcaagcaacaaagttctactctgtccacccgtccatctagctctcaagaaccaacccgtaccagcgctatccggccggccatggcggcggcgcgccggctctccctgcccctcgtcctgctggtcgtcctggccgtcgccgggcgcgcggcggcgcaggactacgacttcttctacctcgtgctgcagtggccgggggcctactgcgacaccaagcagagctgctgctaccccaagtccggcaagccggcggcggacttcgggatccacggcctctggcccaaccgcgacgacggcacgtacccgcagaactgcagccccgacaacgccttcaacccgtcgaaggtgagcgacctaatgagcagcctccgcgccaagtggccgacgctggcgtgcccgtccaacgacgggctgcgcttctggggccacgagtgggagaagcacggcacctgcgcagccgacgtcttcgacgagcacggctacttccaggccgcgctgcgcctccgcgaccagctgggagtcctcggcgcgctcacctccgccggcgtcaagcccgacggcggctactacacgctgagccagatcaagggcgccatccgccagggcaccggcttcgagccctacgtggagtgcaaccgcgacgaggccggcaacagccagctctaccagctctacttctgcgtcgacgccgccggcgacagcttcgtcgactgccccgtcctccccagcggcaggccctgtggcaaccggatcgagttcccggctttctaagctaactcactcttcacgtcagttgctgcaatatactgctagtccttttgcttgcattctatgcaagaggataatggaatgttcattccccattcttcatttttttttgcaaataaaaggagggcgatcggtgttccatatttattatgttgatcataacatgacattcagagaac

SEQ ID NO: 8829 - DNA, 2211 bp, Zea mays
ccgctgctgttggattcgccgagccggagccgccggagatgaccgtcgacgagctgaagctgcaggcgagggccagcggcggccacggcgccaaggaccagttccccgtcggcatgcgcgtgctcgccgtcgacgacgacccgacctgcctcaagatcctcgagaacctcttgctccgctgccagtaccatgtgacaacaacgggacaggcagccacggccttgaagctgctgagggagaagaaggaccagtttgaccttgtgatcagcgacgtccacatgccggacatggacggcttcaagctcctcgagcttgtgggcctcgagatggacctcccggtcattatgctgtctgcaaatggggagacacagacagtcatgaaggggattacccatggagcatgtgactacctgctgaagccagtgcgtattgagcagctgaggactatatggcagcatgtggttaggcggaggagttgtgacgccaagaacagtggcaatgacaacgatgattcgggtaaaaagttgcaggtggtgagcgctgaaggtgacaatggcggtgttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagtttgtggctgctgtcaaccagcttggcattgacaaggctgttccaaagaaaatattggatcttatgaatgttgagaacatcacaagggagaacgttgcaagtcatctgcagaagtatcggctgtatctgaaaagactcagcgcagatgcaagcaggcaggctaacctaactgctgcatttggaggaagaaaccctgcttatgtgaacatgggactagacgccttcaggcagtacaatgcatatgggagataccggccagttccaaccactaaccattcacagccaaacaacctccttgcaaggatgaactctcctgcatttggtatgcatggtctgctgccttcgcagccacttcagattggacacaaccagaacaatctgagcacttccctagggaatgtcggggggatgaacaacggcaacctgatcaggggtgcgcatatgccactgcaggatactagcaaatgctttcctactggcccttctggtaattcgttcgcgaacatatcaaacagcacacaactggttacgacaaacaacttgccattacagtctcttgagccaagcaaccaacaacaccttggtcggctgcattcctctgcagaccctttcaactcatttgttggtgagcccccccagtttgcagatcttggaaggtgcaacaccacctggccaaccgcggtctcatcatccaatgttcaggagattggccagaaggacaggatcgtgaataggcccaagcttgagcctctctcaagctttacagaagcatccagtcagatccctttgctgggaagtgaaatgcagagccaccaagtagcatcactagccagcaacggtcttccgatgccgttcactcaggaagcggtgcccttcgcttatggaagcagcacgaactcgagagagatgctgaataacaaccttgcgcttagtaattcaggcgtcaactctacattgccgaaccttcgcatagacggttctgttgttccagggcagacactgggtggtagcaattcaggtggttgtgttgtcccccctctgcaagatggcaggattgatcaccaagctgtcagcagtcatctaaactacaacaacgaactcatggggacaggtaggctgcaaaggggacttagtggtggtctggatgacattgtcgtggacatgtttaggccggaccgcgcagacgatggcgtctccttcattgatggggactgggaactggtctagcaagtttcagttctctacatcaagtctgccttcgtgtgagattttccgcatttgtggttgtggaggggttcggcgcttgattggtccaaagttgtttatagtagcaagattgcatcacaaatgccctttgcatttggtttttcagtttagcgaccaggttccagtgtcacgtccgaatatcaactatgtggtatttgctaccttaactcgtatggctatgttttcaagtcaggtgttaactgtggctatcgtgatatatacagcatggttatgagcc

SEQ ID NO: 8830 - DNA, 1499 bp, Zea mays
atcacctccgccgctctccaccatgaatcccatccaccagcacggcatcgtacccaatccttcgtgactgttgcctccgcgcatctccgggagcaatggaaggaggccgagatgtgttcttaggtgcggcggcaagggcgccgccgccgccgccgtcttgcccgtttcacggatccgctaccgccacccgctccggtggagcgcagatgctcagcttctcctccaatggcgtagcagggttgggtctgtgctcaggtgccagcaagatgcagggtgtgttgtcgagggtgaggaggcccttcactccgacgcagtggatggagctggagcaccaggccctgatctacaagcacttcgctgtgaatgcccctgtgccgtccagcttgctcctccctatcaaaagaagcctcaatccatggagcagccttggctccagctcattgggatgggcaccatttcgttccggctctgctgatgcagaaccaggaagatgccgccgcacagatggcaagaagtggcggtgctctagagatgctgtcggggaccaaaaatactgtgagcgacacataaaacgtggttgccaccgttcaagaaagcatgtggaaggccgaaaggcaacaccgaccactgcagatccaaccatggctgtttctggtggttcattgttgcacagccatgctgttgcttggcagcagcagggcaaaagctcagctgctaatgtgactgatccattctcactagggtccaacaggaatttgctggataagcagaatctaggtgaccagttctctgtatccacttccatggactcctttgacttctcatcatcacattcttccccaaaccaagccaaagttgcattttcaccggtggccatgcagcacgaacatgatcagctgtatcttgtgcatggagccggcagctcagcagaaaacgttaacaagtctcaggatggtcagctgctagtctcgagggaaacaattgacgacggacctctgggcgaggtgttcaagggcaagagttgccagtcagcatccgcagacatcttaactgaccattggacttcgactcgtgacttgcgtcctccaaccggagtcctacaaatgtctagcagcaacacagtgccagcagagaatcacacgagtaacagtagctatctcatggcgaggatggcgaattctcagaccgtcccaacactccactgagtgttcatcaggctggtctttgttgggaccacaaaataactgaagccatgttgatgtcctgagtttgctgatactaggttttcagtcgagtcttgtaactcctgttttagagctgttatatgttcacgtcatgtcgcctttcattttcggttcattcagatgggtgttctaataatttctttccttcttacctgtgaaggatttgagttccaatctgagacgtgggtttgttctaacttggaggtatttatgaatattaggcacttctgatttccattgaagcgagatttcttt

SEQ ID NO: 8831 - DNA, 1241 bp, Zea mays
ccaagttgtcgatcacttgcctgctcttgagctcgatcaagctatcatcagctacagcttccgatcccaactgcaactgtagcagcgacaactgccatggaggcccagaacgtggaggttgctgccctggtgcagaagatcacggccctccacgccgacatcgccaagctgccgtcgctgagcccgtcccccgacgccaacgcgctgttcaccagcctcgtcatggcctgcgtcccgccaaaccctgtcgacgtgaccaagctcagcccggacgtccaggggatgcgagaggagctcatccgcctctgctccgacgccgagggccaccttgaggcgcactacgccgacatgctcgccgccttcgacaacccgctcgaccacctcggccgctttccatacttcagcaactacatcgacctgagcaagctggagtttgacctccttgtccgctacatcccagggctcgcgccttcccgtgtcgccttcgtcggctccggccccttgccgttcagctcgctcgtgctcgccgcgcgccacctgcccaacacactgttcgacaactacgatcggtgtgccgccgccaacgaccgtgctcggaagctggtccgtgcggacaaggacctgaacgcgcgcatgtccttccacacggtcgacgtcgccaacctcacggacgagctcgccaagtacgacgtggtcttccttgccgcgctagtaggcatggcggctgaggacaaggccaaggtggttgcgcatcttggcaggcacatggcggacggagcggctctcgtcgtgcgcagcgcccacggggctcgcggcttcctctacccgatcgtcgatcctgaggacattcgtcgcggtgggttcgacgtgcttgccgtgtaccacccggacaacgaggtcatcaactccgtcatcatcgcgcgtaaaatggacgcccacaccaaggggcttcagaatggacacgcgcatgcacgcggcacggtgccgatagtgagcccgccgtgcaagtgctgcaagatggaggccaacgcgctccagaagagagaggagatggcgaccacgacagagctgtccatctgatgcaaggaacttttgagcacctatgcgtgcgtggtaacaataatagttacaaatcgctgctgctgaatttctcatgcacttctttattcgatgctatgcattgtgaagtgtttaataagaatgtgttcttcctatgtgatgatatatgccaagttgctagc

SEQ ID NO: 8832 - DNA, 1339 bp, Zea mays
gcgcgcccacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgtcgccatcgcggtctcgcgcctcggcggcggggccgcctttgtcggcaagctcggcgacgacgagttcggccgcatgctcgccgccatcctccgcgacaacggcgtcgacgacggcggcgtcgtcttcgactccggcgcgcgcaccgcgctcgccttcgtcaccctgcgcgccgacggggagcgcgagttcatgttctaccgcaaccccagcgctgacatgctcctcaccgccgacgagctcaacgtcgagctcatcaagagggctgcggtcttccactacggatcaataagcttgattgctgagccttgccggacagcacatctccgtgccatggagattgccaaagaggcaggtgcactgctctcttatgacccaaacctgagggaggcactatggccatcccgtgaggaggcccgcacccagatcttgagcatctgggaccaggcagacattgtcaaggtcagcgaagtcgagctcgagttcttgacaggcatcgactcggtggaggacgatgttgtcatgaagctgtggcggcctaccatgaagctgctcctagtgactcttggagatcaagggtgcaagtactatgccagggatttccatggcgctgtgccttccttcaaagtacaacaagttgatacaactggcgcaggtgacgcgttcgttggtgctctgctccaaaggatcgttaaagatccatcctcgctacaagatgagaagaagcttgtggagtcgattaaattcgctaacgcgtgcggagcgatcaccaccacgaagaagggggcgatcccgtcgctgcccaccgaagcggaggtcttgcagctaatagagaaggcttagatcatcatcgtcctgtacgccatggttttcaccagcttctacttcttcgaattgtattggattctgatatggaacagaagaagaagcggctgccccatcttaccagccctttttgtttgccctagtttccccttgtgaaaagggtgttttgttttataaactctacttgcaataagcagagcctttttttaattatgtcagggtgcatttgatacgatcgaataatcatcaatccataattgtagcaatttttttttaaaaaaagaaaagtcaattgagtttt

SEQ ID NO: 8833 - DNA, 766 bp, Zea mays
cagatggtgatggtgtcaggcggcgggggtaacgcgtgggcgaaggagatgaccctccgccgcaggatagccagcatattcaacaagacgcaggaacacttccctactctgaaggactacaacgattatctggaagaagttgaggatatgactttcaacctgatcgaagggatagatgtcgaggagattgaagcaaaaattgcaagataccaacaggaaaatgcggagcagatatacttgtccagagctaaaagggcggaagatcttgcggcagcacttaaagcaagcaggatgaaccctgtaaaggccgaggccaatgatacggctgctgggagttctcagggtattagtggcggggcaggagttcagggccagtatgcacctgccgctgttcttgggggagtggctcagccccgccccacaggtatggcgccccaactaatcggcagtgggtcggatcctctgcaaggagacgacgaggagaccaggagactacgcgcagagcgagcagcacgggctggcggatggactgctgaattgagcaagagaagagcgcttgaggaggcgtttagcgccatattcatctaggattagatcaaaaggcaacacatggcctgcattggcattggtaaaacctgcactagttctgcaggacaaagaataagaactactcaatcagatgccgccatgcaaaagttaaaatgtgtctctatccatggcagggctactctaaaactaactaaatatattactagtggtctttcac

SEQ ID NO: 8834 - DNA, 1145 bp, Zea mays
agcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcctaaatc

SEQ ID NO: 8835 - DNA, 1158 bp, Zea mays
cggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 8836 - DNA, 1142 bp, Zea mays
ggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcct

SEQ ID NO: 8837 - DNA, 738 bp, Zea mays
gaacagctgtcgatccaattgtcacttgctctccctccaacaagctaattaaggccggtcatccctcttctagctcgtttcattatccatggcggaggagaagcaccaccaccaccacctgttccaccacaagaaggacgaggagcaggaggagcagctcgccggcggcgggtacggcgagtccgccgagtacacggaggccacggtgacggaggtcgtgtccacgggcgagaacgagtacgacgagtacaagaaggaggagaagcagcacaagcacaagcagcacctcggcgaggccggcgccatcgccgccggcgccttcgcactctacgagaagcacgaggcaaagaaggacccggagcacgcgcaccgccacaagatcgaggaggaggtcgcggcggcggcggccgtcggctccggcggcttcgccttccacgagcaccacgagaagaagaaggaccacaaggacgccgaggaggccggcggcgagaagaagcaccacttcttcggctgattgatcctcccgtatcgtcgtccctccccgtgtgctacgcgtgcgtgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttactt

SEQ ID NO: 8838 - DNA, 810 bp, Zea mays
ggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaaggtcgctctgtgtcagttgttagtgctgtgttcatcctcggctccagcagacccatgcatcaaccagcatggactgcggatcgatgggtgctgttacccccgtcaggctttattctaagttaaatcctaagg

SEQ ID NO: 8839 - DNA, 1814 bp, Zea mays
cttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccctccgagcccacccacaccaaggtgaagcagctgctcttctccctcctgctctcccgcaaggacgacgtgatccccaccttccgctccaacttctcctcgctcctcgccaccgtggaggcggagctggccaagggcggcaaggccgagttcaacaagctcaacgacgtcacctccttcgacttcatcggcgaggcctacttcggcgtgcgcccctcggcgaccgagctcggcaagggcgggccgagcaaggcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaataagacttctctctcaccctcggccccaccttcacgtgtgattggaggtgtttgtcgcttttgtaataattataatgcaggatggcatgttgcataaattgctccccaaaaaaaaatcttatctttcacaagaaatctataatcccttagcagccttgcctttcatacttttc

SEQ ID NO: 8840 - DNA, 2054 bp, Zea mays
ggaagatgagggagtgcatctccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatagatgatggaagtcgatcttgggtgccaccacgtcgaagcggcttgtgctgtgtagatccggcgaaagcgcgcaggcaaagcccgggtctgcgtcgtcattggcctcatgatcttcgtattgccatcgcgctaaagggaacgaaggcgacgaggtcttaaactttgattgatatatgcggatatgaaaatgcatgcaactacatgctagaagtctgtcttggttgtgttggagaaaaattctttgttacgtttttgttgatagtgttgagtgccaaaaatggagcttctccctgttgaagtcgttggcaacattctttcccatcttggtgttgcgcgtgatgttatgattgcctctgcggtatgccgcaagtggcgagatgcatgcaggaggcatctccgtttgctgtccttcaactccaatgactttccacgggacatgactacacgtcagttggagattgtcatcacacagactatatttcagactattgggctgcaacgcctttcgattcacattgataacacccatgagttctctgcagcaccagtgattgcatggctcatgtataccagggagaccctccgaagcctgtcttacaatgtcaggacaatacccaatgtaagcattcttgaaaagtgtggtaggcaaaagctcgaagtgctagatttggaattggaccataacaccatcacaggtgttgaaccaagctatcagaggttcacttgtctgaaatccctttccctgaggcatgtcagcattttggccttggatttgagccttttagttgctgcttgcccaagaatagagtcattagcacttgatgtccttgaggttgtcacttcagaattacagtctacgatggagctcacaagccatacattgaaaagtctatttgcaaaatcggtaggtgtagataagatcatacttgatgcagataatttggaagttctgcacctgaatgctttaaatctcgatctgtttgagcttaacgggaaaggaacactaaaacattttaagattgatgatgtcagtgttactcatttggatattggggacaatactgatcatttagaggcagtagacgtgagcaacttcacaatagtctggccaaaattctatagcatgatatccagggcatctaatttgcgtatgctacgattttggggtgttgtgtttgatgacgaggatgagatcgtggattcagaaactatagctgtttcatttcctcttcttaggcatctttcattgagttatgaattacgagatgggttacttcactacagccttcagggatcatcattactggagaatgtctcagttctggaacttggttggacagtaataagtgagcactttggaccctgggtatttggtatgattggaaggtgtccaaatctcaagaaacttgttattcatggtgttctttctgagacaaaaacgcgagaggatcgccagatgttagcaagctttacctcattcatagtctgtgtcatgaggaagtatgtgcatgttgatgtacaatttgagtatgagtgacagctactaggttgggtgggcatcttgtcattgttcagatgaagctgtgccatcagttgcttgatactgggttcttccacattgatccacatctaggcaatatgatcagaacacctgacggagattatgttgcagaactgtatcaactccctctaattttatgttatattatatttggtaggaatttctactgggtctgaaacttgtaacatacagttttctgaagatctacgaaagatagtggatactt

SEQ ID NO: 8841 - DNA, 860 bp, Zea mays
ctctccttggccttcgtctccgccttccggcttcctctagaattcgattccctttcccaagaaaccaagaacccagcccctcaccatgacgagctcctcctctccttccagaaaggcgctgagcaagatcgcttgcaatcggctgcagaaagagctcgccgagtggcagcaaaacccccccgccgggttcaagcacaaggtctccgataacctccaaaggtgggtaattgaggtcaccggagcggcgggcaccctttacgccggcgaggcttaccagttgcaggttgacttccctgagcattatcctatggaggcacctcaggtcatttttcttaatccagcgccaatgcatccacacatttacagcaacgggcacatctgcttagatattctgtatgactcatggtcaccagcgatgaccgtgagctctgtctgtatcagtatcctgtctatgctgtctagttcgccagcaaagcaacgcccggcggacaatgaccgctatgttaggaactgccgcaacgggaggtcgccaaaggagactagatggtggttccatgacgacacggtgtaatgatctccgtggcattgcctgtcagccttctgtactgtgaactgtgatatatctcttcaagggggagatgagatgatttaggcctatttctaagcagccctctattggattgcgaagcttaccttgctgtggtggtatgtaaatgagttgctcacatgtgtcagtctgggaatatgtgttatcaccatcaatgatataatatatagaataaagcaagattgtaccctgcctgagtcactgaaactagctcaaaagtaatgtgcaggtttgactatgatttgttttggtc

SEQ ID NO: 8842 - DNA, 1039 bp, Zea mays
ggcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaagcccatcccgacgcacgccgtcgcgggcatcagcgagctggagggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcgccacaccatcgtctccgctctggatgaatggattcaaacccgtcgtcgtttgcttttgctcctcgcgccacgttcaattaatgcttgtgtatgcatgtatgtgccagtatgatgtgccgttgccctggtccattcatttccctttcttttttcggggtgaaatagatgtaaagatctcgtcttgcctgccgt

SEQ ID NO: 8843 - DNA, 1318 bp, Zea mays
acgacaggttaccttcttcgggcccttctcaccatttcctcatttagaagccccctgtgccttgctcctcggtgtttcctccagatagtagtgtttcctcagtggactagtgtgaagctgtgcttagcgtagcggaagggaggaaggacaaggcaaggcaactgatggcggcgggcggcggaggcggctcggcggcgtcgttcgtgtggaagacgtacacgatggtggaggaccccgggacggcaggggtgatcggctggggcagcggcaacaacagcttcgtcgtcgccgaccccttcgtcttctcgcagacgctgctccccgcgcacttcaagcacaacaacttctccagcttcgtccgccagctcaacacctatggcttccgcaaggttgatccggaccggtgggagttcgcccacgcgtcgttcctgcgcggccagacgcacctcctgcgcaacatcgtccgccgcggcagcagcgccgccggtgccggaggcggaaagaggaaggacgccagccccacggagctggcctccggggacgacatgaccatggtggccacggaggtggtgcgcctcaagcaagagcagcgcgccatcgacgaccgcgtcgcctccatgtggcgccgcgtgcaggagacggagcgcaggcccaagcagatgctcgcgttcctcctcaaggtcgtcggcgaccgcgacaggctgcaccgcctcgtcggcgacgcccccgtgccagataacgggttcgcctccggcggtgccgccgagccgcccgccgcggaggtcggcgagaagcgggccaggctgctgctcgacggtgacagcatggtggcgctcggtcccgaggccgtcgacttcgccgggttctacagcggcggcggtgcgttcggcgatgttgccgtggatgctgccgctgggtcccgcggaggcgggttctcgtttgcgttcggcgtggacgcggggtactgaatgacgagcaggcgccgccattgtcagcagcttggcccgcttatgctgctgtcgagcttcctgccaatgccattgcgctgagcggcggcagccgtcacatggaagcatggcaggggatggatgataatgatgttaagttctatccctgctacatggataggatgtgtgtctgatgctgcttttcgtggatctatatgggcggggagcgactactccgtcgagatctaaaaataaggggatatactgtcatggagtgtgaccttcgaagttcccaatatgagtaggtttgatgttgtacatgaccagtgcagcagcactaatatttcaatctcctgcggatacgcagctgg

SEQ ID NO: 8844 - DNA, 1123 bp, Zea mays
gtacagttgtactgagctgagctgccggaggcagaataggagaggcaggcgatgacgatggcgacgaaggcggcgtgcgtgctggcggtgtgggtgctcgtcgcatcgggcctgtccgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagcctctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctacttcaagtataacgttacggaaatgctgtcaagtggatggatacaggtttcaaatggtaaggaatatgcactgagcgatgtcatcgataccatcaaacatgcttttgggggatcaccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacgtatgatccccttgtgcttgccaattcaactgtagagatcatgacacagttcgatgaatttgaggtgcctgcagctctttatacagcctaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataag

SEQ ID NO: 8845 - DNA, 1925 bp, Zea mays
cttcaacaagctaggcagctgcaagcatctcccaaatcccagcctgctgccccgcgcgaacacacttctcttgtcgttgcattgcagggcagctagccggctacagcatccgccatggcgcgcggcggggacggcctgcaggtgctcagcgcgctggacgcggcgaagacgcagtggtaccacttcacggccatcatcgtcgccggcatgggcttcttcacggacgcctacgacctcttctgcatctccctcgtcaccaagctgctggggcgcatctactacacggacaccagcaaggacaacccgggctcgctcccgcccaacgtcgccgcggcggtcaacggcgtcgccttctgcggcacgctggccggccagctcttcttcggctggctcggggacaagctcgggcgcaagagcgtgtacgggatgacgctcatgctcatggtcatctgctccgtcgcgtcgggcctctcgttcggccacacgcccacgggggtcatggccacgctctgcttcttccgcttctggctcgggttcggcatcggcggggactacccgctgtcggcgaccatcatgtccgagtacgccaacaagaagacccgcggcgccttcatcgcggccgtcttcgccatgcagggcttcggcatcctcgccggcggcattgtcacgctcgtcatctccgccgccttccgcgcggggtatccggccccggcgtacagggacgaccacttcaactccaccgtgccgcaggccgactacgtgtggcgcatcatcctcatcctgggcgccgcgccggcgatgctcacctactactggcggatgaagatgcccgagacggcgcgctacaccgcgctcgtggccaagaacgccaagcaggccgcggccgacatgtccagggtgctccagacggagatcgtcgacgagcaggagaagctggacgagatggtcaccgccgagagcaacaccttcggcctcttctccagggagttcgcgcgccgccacgggctccacctcgtcggcacctccaccacgtggttcctgctcgacatcgccttctacagccagaacctgttccagaaggacatcttcaccagcatcaactggatccccaaggccaacaccatgagcgcgctggaggaggtgttccgcatctcccgcgcccagacgctcatcgcgctctgcggcaccgtcccgggctactggttcaccgtcgcgctcatcgacgtcgtcggccgcttcgccatccagctgctcggcttcttcatgatgaccgtcttcatgctcggcctcgccatcccctaccaccactggaccacgcccggcaaccacatcggcttcgtcgtcatgtacgccttcaccttcttcttcgcaaacttcggccccaacagcaccaccttcatcgtgccggccgagatcttcccggcgcggctgcggtccacatgccacggcatctccgccgcctcggggaaggccggcgccatcatcggggcctttgggttcctgtacgcggcgcagaaccaggacaagagtaaggcggacgccgggtaccccgcgggcatcggcgtgcgcaattcgctcttcgtcctcgctgcctccaacttgcttggctttatcctcaccttcctcgtgccggagtccaagggtaagtcgctcgaggagatgtccggggaggctgacgacgccgaggacgacgccgtcggcacccgcgcggtgcggccgtcggggacccagatggtgtagaatcgaacatggcgacgcgtgcacacgggtcctccatcctggggcccgactgggaagacaaggcgcgccggttcaagcctgccgatgctttgctgtgcagaagtagttcgtacaggtgcatgtgtgttataggcgggaaagtaagtgaacttacatgcttgtatttattatatccaaccttacgt

SEQ ID NO: 8846 - DNA, 1822 bp, Zea mays
catttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaataacttgctttcctc

SEQ ID NO: 8847 - DNA, 2315 bp, Zea mays
cgtttccgcccgcgtcctcgcctcttctttcttcgcctcttctgcaccgcgctctcgctcgcccctccgccgcttggcctccaccctcccgctgccggctccgccgactggacttccgcccgtcgctggccgtcggcgcgcccgttcctcgcaggtgaattgttcaggctgaattgatcggtggaagctgtgcattgactatttttttaatctcagaatcaaagagagaaattgaactgggaggctgctaattgcgagagaagtgatgtctttcgttaggcaagcagacccatcagtgtcctgtgccgagaccacttacatccacaaatttgtgccaccaggaccagttttcccagcacagagatttgtctctggcaccgacttgcttcaccacgggcctcaaccatataatgctgagggctacaagcagtctggtttcaatggcacagcgcctcatgcatttcagagcttttacaatactgatagctatgctgaatctcactttaatgaagcaccatattctcctgcaatcttcgatatatctcagcagaactctcaatctttatcagacaaccaggcctctgatcttgtagagttcgatgaggatgagatgagagtaaagcttcaggagcttgagcatgctttacttgacgatggtgatgagatcttttttgacttgtcagggagcattaacgatgagtggaatgataacattaagacaaacaatgaatgggtcaataccatgaagaatattgtgagccccgactctccaaaagaggcatcacctgagtcaagcatctgctgtctcgacaacaatgttggagaagcgcggaacccgaaacagttgctttttgactgcgcagaagcgatatccgaaaatagcatcgatgaagcacagtcaatcatagcagaactacggcagaaggtggcaattcaaggagaaccttctcagagacttgcggcctatctcgtggagggccttgctgccacactacagtcttcaggaaagggcatctacagggccctgaggtgcaaggaggcccctactctgtaccagctttcagccatgcagatcctcttcgaaatctgcccatgcttcaggctaggcttcatggctgctaactatgctattctcgaagcctgcaaaggcgaagatgtcgtgcacatcattgactttgacatcaaccagggtagccagtacataactcttatccagttcctaaagaataacagtaacaagccacgccttttgaggataactggtgtcgatgatccagagtcagtgcacagagctgttggaggactgaatgttgttgggcagcgactagagaagcttgcagaggactgtgaggtacggtttgagttcagggcagtggctgctaacattgaagatttgacgcctggaatgctaggtcgccgtcccggagaggccctcattgttaactttgcattcctgctgcaccaccttcctgatgaaagtgtctcaattatgaaccaaagggatcggcttctccgtatggtgaagggtctccgaccaaaactagtgacgttggtggagcaggacgcaaatactaacaccaccccattcccttccaggttccgggaggtctatgactactattcggcactttttgattcactggatgccacccttccaagggaaagcccagatagaatgaacgtggagcgccagtgcctcgcacgggaaatcgtcaacatcttagcttgtgaaggtcctgaccgtgtggaaaggtatgaagtggctgggaaatggagagctagaatggcaatggcgggctttgtgtcgtccccatttaacagcggcgcgattgatggcataagatctctactgaaatcgtactgcgataagtacaggttcgagaaggtccaggacggtctccactttggctggggcgacaagacgctcgtcttctcttcggcgtggcaatagaagcttgcttgtactattgcctatctgagcactttccagcgtttttaggagcatctggggcaagggctgtaaagagatttctgtcgccgtattgttgacctaccatataagtacactcgtagctaaccttagcgtgctgcctgcctgtaggcttgtgacttgtgaggtctacggtttacctagtttcttagatgaaagtatgttgtgcattgtacacctactgaactacatgtagactgtagagtcgcgggtgtatttaattttgcccttcttttggaggggcagaatcacaatacgcgtgattggatacctggccgcgtgcgtctgggctctccacattccgttaaaaaaaaaaaaaaaaaaa

SEQ ID NO: 8848 - DNA, 1920 bp, Zea mays
gaattcccgggtcgacccacgcgtccgacgtcggcctcttccacggccgccgccgtcgtcgccgccgccgccacctcgccgccgaccaccataccatcagatatttcagagctcgcgcccctcacgcatggttcttggcttcttgcttcttgctcgacgtgcgccgtaactaatcgactataagcgtggtgacacgtctgacgagatgatgccggtggcggcggtggatgactggtcggagcgcggtttctcgctgacctgcgaggaagactgcgccgacctcggcaacggcgtcgtagacgacgacgagttcctcccgctctacaatgccggcgaagaggaggaagaggagtatttggagcagctggtgtttaaggagaccagcctctgctcctcctccgactcagccgcggactgcgacggcgacggcgaaggagacgaagaatacccctcgctcgcctctgaggagtggtttcggcaagctcgcctcgccgccgtcaagtggattcttgaaacccgcgggtgcttcggcttcggccaccggacggcgtacctcgccatcgcctacttcgatagcttcctcctccggcgacgcgtcgatagggaggcgatgccgtgggcggcgcagctgctgtccgtggcgtgcgtgtccgtggccgccaagatggaggagtgccaggtgccggcgctgtcggagttccacgccggcggctacgatttcgactcggcgtccatccggcggatggagctgctggtgctgtccacgctcggatggcgcatgggcgccgtcacgcccttggacttcctcccctgcttctcctcccgggtccacccgcacggcggcgccggcgccggcggccacgtcgcccacaaggccatcggtttcatctttgccacggctgaagctggtagcgtgcttgatcacaggccgtccactgtggctgcagctgcaatcttggctgcaacctatggacctctactgaccaaagaagcactcgattccaagatgagctacctttctccatcttgtcttattgagaaggaacatgtacatgcctgctacagtatgatggttggggacaataacaggagaggtagcaagagatcattgccatgttcagtctccaacgagattgccactagtacatatcattctgttcttgttgatgatgttacggacaccgccgccgcctttgccacggcggtatcggccaggaataagcggatcaggctggagctgacgggcatcagttgagaaagctagcaccaccggggacacagtttttagccagatgtctaggggggcttggtttgatcttccctttcattttcttcccttctttttgaacttatatgtttgcgaaaaagaagatatttttttaggttctttgagccattgccatgggttggcattggctgttgtcagatttgattggtttggtttgtgagaggtggaagagatgaacaaagcagagggctgagctttcctatggagaggagagcttaggttaataagcccaatgccagcgcccaaacagggcacacttcacattcagtgaactttacttcaaaggttgatgcaatgttgcattgcatgtggtgagagatgctgctgcagagaagatgcaaaacaagtggtaacaacactgagaggttgagggttttgccattgtttatagaacgagtgagcgagagagggagatgtttccctttttcacctgtgcaagtggatgtgagagtggtgtttcactctgcacttgcgagggttacatcgatttgtaacaaaccctgtgtacttgtgtaaccccctcttgttcctgaggaatggaatcagattgcgttttgcgtcaaaaaaaaaaaaaaaaaaaaaaaaaaaaaaaaaaaaaaaaaaaaaaaaaaaaaaaaaaaaagggcggccgc

SEQ ID NO: 8849 - DNA, 1150 bp, Zea mays
ggtgaagcgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 8850 - DNA, 1142 bp, Zea mays
acagaatggggggtttcgtgaagactcataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcccaaatcatatctgctagtatagcgggtgatatggttcttgcttctgcctactcgcatgagttgccacgatatggtcttgaagttggtctgaccaactatgcagctgcctactgcactggccttctgttggctcgccgtgtgctcaagatccgtggtttggatcaggagtacgagggcaatgttgaggccactggtgaggacttctctgttgagccagctgatgagaggaggcctttccgtgctctcttggatgttggccttatcaggactacaacagggaaccgtgtctttggtgccctcaagggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgtttaagttttgcgaggtgaacaaaactgtttctgttagtttcgagcttgagctctcaatgtttactctttacattgaaatgctgccgtttggacatgttttttctgagttctacacctgcttgtcttgctt

SEQ ID NO: 8851 - DNA, 1760 bp, Zea mays
cgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctc

SEQ ID NO: 8852 - DNA, 2145 bp, Zea mays
cgcccccctccgcctccgccgggcaccaccacctcatccgccaccgccacgcccacgccccggtggccgctgcgcccctccgcctcagtctcccgcgccacctcccccggtccaccccgctccgcctgcccgccgcgctcccgctccgccactgcctcccgcccctccgcgccgcctccgccgccgccgccgcagtcccagcgcccggggacgacgcgtcgcccaagttcctgggcgtggagacgaagacaatcaagaagatcgtgcccctggggctcatgttcttctgcatcctcttcaactacaccatcctgcgggataccaaggacgtgctcgtcgtcaccgccaagggcagcagcgccgagatcatcccgttcctcaagacctgggtcaacctgcccatggcagtcggcttcatgctcctctacaccaagctcgccgatgtcctctccaaggaggcgctcttctacgccgtcatcttcccgttcatcgccttcttcggcgccttcgcctacgtgctctaccccatgcgcgacgccatccaccccactgcgctcgctgatcgcctcctcgcctcgctcgggcccagcttcctcggacccgttgccatcctccgcgtctggagcttctgcctcttctacgtcatggccgagctctggggcagtgtcgtcatatccgtccttttctgggggtttgcaaatcagattactacagttgaagaggccaaagagttctacccgctgtttggccttggtgccaatgtggccctcatcttctctgggcgcacggtgaaatatttctcaaacatgaggaagaatttgggtcctggagtggatggttgggcaatttcgttgaaggccatgatgagcatagtggttgtactgggtcttgtcatcaccggtatctattggggagtgaacaagtttgttattgataactcatctgtgcccgtggttgagcggaaaaagaaggacaagccaaagctcagcatgggtgagagcatgaaggttctgttgtcatctcggtatgtgagggatcttgctacattggttgttgcttatggaataagcattaaccttgtcgaggtgacatggaaatcaaaactgaaagcacagttcccaagcccgaatgaatattcttcattcatgggcgatttctcaactgccaccggcatagctacatttacaatgatgttgttaggaagagtgatcctcagaaagtttgggtggggagttgcagctacaatcacgcctgcagtgttactcctcacaggagttgggttcttctcactgattttgtttggtgagccattgactcctcttatgaccaagtttgggatgacacctttgcttgcggcagtctatgttggagcaatgcagaacattttcagtaagagtgcaaaatacagtctgtttgatccttgcaaagagatggcatacattcctttggatgaggatatgaaggtgaaaggtaaagcggctattgatgttgtgtgcaaccccttggggaaatctggaggtgctctgatccagcagttcatgatcctgtcattcggatctctcgcgaactcgacaccctaccttggcggaatactcctggtgatcgtccttgcatggctgggtgctgtaaggtccctcgacctgcagttctcttccctggcgaagcaagagctcggcagagagaagctgctgaaaacgcaggccgtcgaaacggtcgccgaagtagtcggcactggaaacggttctctccaagaaactctagctagtgagccgtctgcaaatggcgcggccaccaaacagtcgcaagaacctgagagcacagcccctgagaaatcaggccagcagtctcaataagttctccccccaagaaatttagctagcacgagccttttggaggaaccggaagtttcttatctggagctactgaagaaggcaggaatcatgccagaaataagaagggcctgttcttcttgtgttgttgtagcgtttttgtttttaaacttcgccgtatctgtagctgtttgtttcattccataggtatgaactgtttatgttcgttattaaaattttgggaggtctgcttcatcgtaatcttcattagcagctggtccttgttgtggaaaaaaatattttgcatggttttgat

SEQ ID NO: 8853 - DNA, 2536 bp, Zea mays
gggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggttcgctaccaaagcaggaagaggcttgctgagcagcggccacgggtccgaggacagtttgtgcgacaatctgagcaagaagatcaaacagcgcaaggttcagaaagatgacacgtaatttctaatacaacgtatcatcttcttcggcagatctgagaattaggcggttcttcctattgcgcatcttcgtcgacagatctgagaattaagtggtccttcccattgctgatagtagcccactgattcccaacgttagagtacacaataaataagactctagttgtcaatttctgtggttgactgcagatgatcaccctagcgctatggagtcaacaatgtaatatttatatactatgttcgtgccttggcgccttggcggtttgcaatcttcagtttcctttctgag

SEQ ID NO: 8854 - DNA, 849 bp, Zea mays
gttgtttgtctcttgcaaaccgcaatggctgctgctgccactgctactccggccgtggcgccggaggccggcgaccggaaggcggtggcaccgccggtcgacgcggtggatctggagctggagctggaggagaagcacgtgctggcggtggacgacagctccgtggatcgcgcggtgatcgccaagatcctgcgcagctccaagtacagagtgacgaccgtggattcggcgacgcgcgcgctggagctgctggcgctggggctggtccccgacgtgaacatgatcatcacggactactggatgcccgggatgaccgggtacgagctgctgaagcacgtgaaggagtcgtcggcgctgcgggccatcccggtggtgatcatgtcgtcggagaacgtgcccacccgcatcagccggtgcctggaggagggcgccgaggacttcctcctcaagcccgtccgccccgccgacgtctcccgcctctgcagccggatccggtgaccgcccgcgcaaggatggaggatctggttgcgcgctctgacttaattagaggagttgttaggatccaattttttgtgtgttcgttcgttcgttcgttcttttctttctttcttcttggacatagatctgctgccgccgctgctgccgtcgactgaaacaagaagctaacttagttttagggtccaggttgttgttgttgttgttaggaaggcgagtcgttgggggcattcacggatgttcttcctcgtttcccctccctccgtgcctgaggctgcaaaaatatgccccccagacatgaaaaaaaaacaagacctgttaacagttccaagatcagagccttcgcttcttttc

SEQ ID NO: 8855 - DNA, 1593 bp, Zea mays
gtggtttgcttgcccacaggcggccaaaccgcaccctccttcccgtcgtttcccatctcttcctcctttagagctaccactatataaatcagggctcattttctcgctcctcacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactacaagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaact

SEQ ID NO: 8856 - DNA, 1424 bp, Zea mays
agcgatttcgccggggggagatcttgccattccgtggagcaccatccgcggtagcctagccgcgactggggatcggggcttgcgggccgtggagccacccagaaggtagccgggaaaagcttgatccggccggggacggggccttcggaggttcgtccctcgatcgggtgtcgtctgcgaaagccgggtcgaacaaatcgtcgcgactggaggcggcgcggggtcatgggggcgtgggtctcggtcctgctcgggatggacggagccgcggcggccgggcctgctgctgtgggcctgggcgacctgccggagctctgcgccgcccaggtgctgctccggctcgacccgccggagatctgcaggctcgcgcaggtcaaccacgcgttccgcggcgccgcgggggctgacttcgtgtgggaagccaagctgccggagaactacaactatctgatggagttcgtggggagcggcgacgaggggaagcggaggcggcggcgggccgggaagaaggagatctacgcgaggctcgccaggcctgtgccttttggcgacggcaagaaggaattctggttggacaagaacaaaggcatgatctgtatggcactgtcgtccaaagcactggtgattactgggattgatgacagaagatactggcaacacatgccaacttcagaatcgagattccagtctgtagcctaccttcagcaaatctggtggtttgaggtggttggtgaagtcgatttctgcttccctgttggaacatatagcttgtacttcagggtccatcttgggaagttctacagacgatttggccgccgccagtgcacctcagagcatgttcatggttgggacaagaagcctgttcgcttccagctatcgacctctgacgggcagcaggcattgtctcagtgctacctggaggagcccgggagctgggtcctgtaccatgctggcgattttgtggcctcaaagcctgaccagctgatgaagctgaagttctccatggcacagatcgactgcacgcacacaaaaggcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagcctgatcttatttttactttgggctctagttcgcagcagaggtgaagtgtatgtggttgtagaactcaggtattgtgtggtcaggtgaccaccagagtgctctgtcagtcctttggcaaggtcgttttcgccccccttcagctgaatttggacagcgagatagccatgaaactgtactgaaatgagttcgaaggtgtcattcccagtttctaatttgctttctactgcttagtttcggatgctcccttt

SEQ ID NO: 8857 - DNA, 1152 bp, Zea mays
gccggtcgccggtcgccgctcgcaacgcaagtcggaagaggaatctctccaagctccaatcctccgatcctgccccaacccaagtcccctccaccaggccgcacacctccgccgcccggcgcgaccttgcatccaccagcctgccctctccttcgcgtgaggcggccccggcgaccgcgtcggcagtgcaagaccagaccgaggcttctcccgttggaaggttccagccatggcgagcgccgatctgctgcggaaggaggaggagttctactcctccctctttgattccgcaaaaggcgacggcgtcaagtcgcgctcgcaggtgattgagaggaagattgaatccctcgaggacatggccaccaaggtcagcaaccggagatcaagaagatggttgaacgaccgcttgctgattgagcttgtcccacgccttcatgttgaagaaatcaaaggcctctttgctcctccaccatggggtgaggagctgcccttgtcagcattctgcaggacaagtgttagtgactgggaggccttcaggagcatcgacatggatgctgaggcaagattgatgcaacacatgaaacgatcatccgaaaaacaaaggactcatgtcgacgaagatgaattgattgctctgaatgcttggcgtcgtataggtcgccaaacaagagaagctattaagaaaaaatttctacctgatctacttcaaatatatgaagaacaggttagggccttcattgaaggtactggtgacagcgacgtgcttgtgctgaatgtccaggacccgttccagaggctgcttctgcacggtgtttgtgagttctataacgtaacctcaatgaccacaagcagtgtaagggacgggaagccatggaagagcaccaccatcaagaagaggcatgtcaccggtcttcctccgagaatcacattagttagcttcctgaggatgaggaagaattagtcgtcccagtaacatgtggatgtgagggtcctacactaattcgcctggatgtgtactaaaaagacaaatttgttgctttaggtcgcatctagcatgtaatcaaatgtaaaatatccatgtcaaatgtaaaatacattgcaagaccttgttccagatgaagaaactcaaaagtgtaagcccctacttctatc

SEQ ID NO: 8858 - DNA, 972 bp, Zea mays
tggagagccattcgtgggcgtaggacgagagagagaggatcggagcagtacgcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaaggaccagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatcctcactgaagacgggcagtcgtctgaatctgtaatgactgcattgcattcaggaagctcgctcgactgtgatgatggttccgatatatccttgaagttgtcgttgccttgaaaggaaggaccatcgcatcgcatgttatctgcatgagtggggctgacaccagtgcttctaagaagacaaagactgggatagtcccattcgcggcattatattggtttaaccagatgtgctgtccttgtgcatgtctgtacttcaaagtggctaacgcgaaatttgtatatataatagtgtatgcgctgcgttatcttcgttctaaaaatctgtattgttt

SEQ ID NO: 8859 - DNA, 2088 bp, Zea mays
ggcgcacgccgaggagagagaaagggggtgtgcggggcggcgaccggcctccgacgacgcggggcgtcgcggcgtcgtggcggtgaagcggatgaggctgtgggaggaggaggacgatgacgaggacgaggaggggatggaagtggacggggaggcggaagatgagccggggtggccgtgtggggcgccggaggcggggcccggcgaaacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacaccccctcgttgatcccatggtcgtttcagagattcggcgatgtctcagcgaggggatcgaattccaaggcgagctgctgaatttccggaaggacggtgctccacttcacaacagattaaggctcgttcctatgcacggcgatgatggctatgtgacgcatgttatcggaatccagctattctctgaggcgaacatcgatctcagcagcgtatcttatccggtgtacaagcaaaagtccagcagcaggcccagcattcaagatctgaactcatctccccacgagcacgctccgaaaatccagagcgcagaccactgcggcatgcttcagttgtcagacgaagttctcgcacacaacatcctatcccgcctgtccccaagagacgttgcgtccatcggatcggtgtgcaccagaatgcatgagctgaccaagaacgatcacctgaggaagatggtctgccagaacgcgtggggaagggacgtcaccgtgaggctggagatgagcaccaagatggtaggatggggccgtcttgcgagagagctaacaactctcgaggccgcctcatggcggaagttcacggtcggagggcgtgtcgagccttcccggtgcaacttcagtgcctgcgctgttggcaaccggcttgtcctgttcggaggggaaggcgtgaacatgcagcctatggacgacacgttcgtgctcaacctggaggccgcaacgccggagtggcggcgcgtcaaggtttctgcctccccgcccggccggtgggggcacactctgtcgtggctgaacgggtcgtggctggtagtgttcggaggctgcgggcagcaaggtctgctcaacgacgtcttcgtcctcgacctcgacgcccagcagccgacgtggagggaggtcgcgagcgagggccctccgctgccgcggtcctggcacagctcatgtaccctggacggctcgaagctcgtggtctcaggtggctgcgccgagtctggtgtcctcctcagcgacaccttcctcctcgacctcaccaaggagaagcctgcgtggagggagatccctacgtcctggtcgcccccgtcccgcctcggccacaccacgtccgtctacggcgcgaccaagctgttcatgttcggtgggctggcgaagagcggctcgctccggctgcgctccagcgacgcctacacggtggacgtcagcgaggacagcccgcagtggaggcagttggccacgacgaccgggttcccaaacgtcagtccgccgccgaggctcgaccacgtcgcggtgagcctgccctgtggacggatcatcatattcgggggctccatcgcggggctccactcccccgcgcagctgttcctgatcgatcccgcggaggagaagccgatctggaggatcctgaacgtgcctgggcagccccccaagttcgcatgggggcacagcacctgcgtggtcggcggtaccagggtcctggttctcggaggccacactggcgaggaatggatactgaacgagctgcatgagctctgcctggcaagcaggcccgacgaggacggctgatgacttcttttcgttgcacttgcacacatatggttcgttcgtctctctctgttttacgtcctatatatgcgcgctatgtcttgtttgtgtatcatctactttcagtctgttgctgcgtcgtgtcggtccgtcggtatgagaaaaaaaaaagcggaaattgatttttt

SEQ ID NO: 8860 - DNA, 1816 bp, Zea mays
ctcccgttccatttccccatctcccagatccaattcgcgagttctccctcctctgccgccatggcgctctctgtggagaagacctcgtctggacgggagtacaaggtcaaggatctctcgcaggcggacttcggccgctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaat

SEQ ID NO: 8861 - DNA, 1810 bp, Zea mays
tcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgttt

SEQ ID NO: 8862 - DNA, 2767 bp, Zea mays
acggcgcaccgcccgcccgccggatctgcgccggcgacgcgcccggacgtcggatctacgccgccgcaggaggggggaggcggcgctgtggccgttctctgcccgcgagcgcccggatccgtcccgccggtgacttcatctccgctaatccaacggataggcaaaactctaatctttgtcaaccatcaagttgatgcagaggtggtgaaaacatcttctcttctccaaagactgctgactgcaagttgcaaaagtttgtcttcagcttgctgtgttctttcttccctctctggcggagtacacgagaagtttgtagatataggcactaggcagctcctttcagctcttctatgtccagggatttggactgtcctgttcagacacagatggctgtggcagtcctggaccggagcttcagcagtgaatatcctggaggcagcagaactgaggggaggcaactgagctggaagagagtctttgtgcaaactgacaatggttctgtccttggcattgagctggagagaggagaaaatgtgcaaactgtgaaaaagaagctgcagatagctctcaatgtgcccactgatgagagttcattgacctttggtgacctggttctgaatgatgatcttagcagcattcgcaatgactcaccgttgcttctcaaaaggaatcagattcaccgaagcaattccacaccttgcctctcccctactggccaggatgtttggcaaagagaccggagtggacccattgaaatacttggctgttcaagcccttcatctcggatgaagcagattgcgaaggatgtcattaaggccataatgaatggtgtcgacccagttgctattaacagtgggatgggtggtgcctactacttcaagaacatttggggagagcgtgttgcaatcgtgaagccaactgacgaggaaccatttgccccaaacaacccaaaaggttttgttgggaaggctctggggcagccaggcctgaaaagatctgtacgagttggtgagacaggcttcagggaggttgctgcgtacctcctcgactatgatcactttgcaaatgttcctcccaccatgctggtcaagataacacacaccatcttcaacgtgaatgactgtgttggctgcaaaagcaaagtattctgcaacaaatcagagtctgtgagcaagattgcatcactgcaggagttcattcctcatgattttgatgccagtgaccatgggacctcaagcttccctgtatctgcggtgcataggatcggaatacttgacattaggatcttcaacactgacaggcatgctggaaatcttctgatcaagaaggttggtcctggggctgacaatttcggagagcagacagaactcattcctattgaccacggtctttgtcttccagaatgcctagaagacccctacttcgagtggatccactggccgcagtcgtctgttcccttctccgtcgaggagctcgaatacattgcaaaacttgaccctataaaggacgcagagatgctacgcgtggagctacctatgatacgggaggcgtgtctcagggtgctggtgctgtcgacagtgtttctcaaggaagctgcagcgttcggcctctgcctgtctgagataggagacatgatgagcaggcagttcacagcaaaggaagaggaaccaagccagctcgagcttctctgcatggagacgaggaagtgggtcgaggaaagagagttatttcttcccgacgaagccggagttgaagacggcgatgatgacttcacccagttccctctcgacagcgacgccttcgaaccgccagctttctgcaagtttggcagcgtgaagacaagttccaggaatccactatccaagctggacgagtgtgacgaggaagacggagacttgtcggaagaggagggcgagcacggtgacgtcctgaccagtggtgcattgccccagaaggttcctcccatctccaagctgtcgtcgtccatgaaggggcttggcttcatcgggaaatcgaaaccctaccgtacaggtggcgtccccaagggtaaggtgacaggtagaactaactacagtggcaaagccagcgagcatcagtccgggagccggagcgccaacgagctgctcccgcccagcgcgagtttcgtgaagctgtcggacatgagccgcaaggagtggagcgcgttcctcgagaagttccaggagctgctcccgagcgccctccgcacccggaagcacagcgccggcgtcggccagcgcccgatgccgaggctgggcacgtcttgccagttttgaaggtgtagaggagaagccaccaccaaggtaaaaaaaatggatgtatacctccgttttagctctggtgtcgtgcaggtgcagcagtcagcaggtattattataacaaaaaagcttgtaggtgtatggagccagtagaagaggttgtctgagaataagatcgtcgatggcacagatgagatgagcttggattgcaggagagtggtgtgtttgtgcatagtgttttgacatatgagatgcgttgttcttttctttttttttctttttcttttttgtatatagtgagtactcctgccgcctcgcaacaccgggctcgatctcggccgttacctgatggttggtggtgagtgtgcttggcatcgcctgtgttctgtctttgccgctgtaccattttggagacgcttaccataatatgaacagctgtgatatgatatcgctacagatatatgcataaataacacctgatagtctgcttc

SEQ ID NO: 8863 - DNA, 1973 bp, Zea mays
cttcgtcgtcctatcttataatcgcatttcgaaatccccaaacggaagcatcgccactcttccgaacctgaacaatcaccaccgttattaagaagatgatgcgctgcgctgcaacgggcggcgggtgcgtcgcttcgtggagcggcgatcggagattgccggcggtcaacccctgcagcgtgcggatgccgacgggcaacgatgggtggtgcgccggcctgaggtcgcgggcggcggatctcgccggcctcgagatggccaacctgcgcggcggcgtcggggggctcttccgcgcgagcccgcgctacgggcgcttgcaagccacggcggcagttgaccctgaagatattccattggagaaggttcaagttaaatcctcaggacatgttctgccatatgttggcgttgcttgtttgggggctattctgtttggttaccatcttggtgtggtcaatggcgcacttgaatatctcgccaaggatcttgggattgctgaaaatgctgtcttgcaggggtgggtggttagcacatccttggctggtgcaacactaggttcttttactgggggttctttggcagataaatttgggcggacaagaacattcatcctggatgcagtcccacttgctctaggtgcattcttgagtgcaacagctcaagatatccgcacaatgattattggccgattgcttgctggaattggtatcggggtctcatctgctcttgtacccctttacatatctgagatctcaccaactgaaattcgtggaacacttggtaccgttaatcaactttttatttgcattggaattcttgcagctttgttagctggattgcctctggcaggaaatcctgcctggtggaggacaatgtttggaattgctgtagttccatccattctgctggctgtaggaatggccttttcgcctgaaagccctcgttggctattccagcaaggaaaggttactcaagcagaattagctgtaaaaagactgtatggaaaagaaatggttaccgaaattatgtttgatctgagagctagtggccaaagttcttcggagtccgaagccggctggtttgatcttttcagcaagcgttactggaaagttgtgagtgtgggggcagcactgtttttgttccagcagcttgctggtataaacgctgttgtatattactctacatcggtgttccgtagtgcaggcattgcatctgatgttgctgctagtgctcttgttggagcagccaatgtttttggtactatggttgcatcttctctaatggacaaacaaggaaggaaaagccttctgataacaagcttttctggaatgggtgcttcaatgctactcctagcattgtccttcacctggaaagctctggcaccttattctggtactcttgctgttgttggcactgttctgtacgtgctgtcatttgctctaggagcgggccctgttccagcgctacttcttcctgaaatatttgcctcgagaataagggccaaggctgtcgcattatctctaggcatgcactgggtatctaactttttcattggcctgtacttcctgagtgtcgtgagcaagtttgggatcagcaacgtgtatctgggatttgcatcagtatgtgcccttgcagttctgtacatagctgggaatgtggtcgagaccaaggggagatcacttgaagagattgaaagggagctaagtgtagcagaatgatgtacttttgctagtcatgctgtggcgccgttttggttatcgagaatgcaaccaagcgctcaaccgagcattcttggacctggagactctttctagtttcatgtagttttagaaataagcgaacggcaagagtaccaatcttaggtgacttggtgtgtgcaatgaggggttgtgtcagaaataagtgaattggattgtagaatttcagaaataagtgaattggattgtagaatttcagaaagtgtgttccccttattt

SEQ ID NO: 8864 - DNA, 2187 bp, Zea mays
ctccactctctcttctccctccaataattctctccacccctgcttgctgcagcttcaagcactaccgaatcagggcgagtgggagcagaggagggaatcccatgtctccgcccctcgctggagcagatcgttgtcgagccgacgtggagctgctgcggtagaaagctagcggagcctgcgagctagcctgatccgtccgcagtccgatcgggatcgatgggtggggaggcgccggagccgcggcggctgacccgggcgctgagcatcggcggcggtgacggcggctgggttcccgaggagatgctgcaactcgtgatggggttcgtcgaggacccgcgcgaccgggaggccgcgtcgctggtgtgtcaccggtggcaccgcgtcgacgcgctctcgcggaagcacgtgacggtgcccttctgctacgccgtttccccggcacgcctgctcgcgcggttcccgcggctcgagtcgctcgcggtgaaggggaagccccgcgcggccatgtacgggctcatacccgacgactggggcgcctacgcccgcccgtggatcaccgagctcgccgcgccgctcgagtgcctcaaggcgctccacctccgacgcatggtcgtcacagacgacgacctcgccgagctcgtccgtgccagggggcacatgctgcaggagctgaagctcgataagtgcaccggcttctccactcatggactccgcctcgttgcccgctcctgcagatcactgaggactttatttttggaagaatgtcaaattgatgataagggcagtgaatggatccacgatctcgcagtctgctgtcctgttctgacaacattgaatttccacatgactgagcttgaagtgatgccagctgacctaaagcttcttgcaaagagctgcaagtcactgatttcattgaagattagtgactgcgatctttcagatttgatagagttcttccaatttgccacagcactggaagaatttgctggagggacattcaatgagcaaggggaactcagcaagtatgtgaatgttaaatttccatcaagactatgctccttgggacttacttacatgggaacaaatgaaatgcccattatgttccctttttctgcaatactaaagaagctggatttgcaatacactttcctcaccactgaggaccattgccagctcattgcaaaatgcccgaacttactagttctcgcggtgaggaatgtgattggagatagaggattaggagttgttgcggatacgtgcaagaagctccaaaggctcagaatagagcgaggagatgatgaaggaggtgtgcaagaagagcagggaggggtctctcaagtgggcttgacggctatagccgtaggttgccgtgagctggaatatatagctgcctatgtgtctgatataaccaatggggccttggaatctatcgggacattctgcaaaaaactatacgacttccggcttgttctacttgatagagaagagaggataacagacttgccactggacaatggtgtccgagctttgttgaggggctgcaccaagcttcggaggtttgctctgtacttgagaccaggagggctctcagatgcaggtctcggctacattggacagtgcagcggaaacatccagtacatgcttctcggtaatgttggggaaactgatgatggattgatcagcttcgcattgggttgcgtaaacctgcgaaagcttgaactcaggagttgctgcttcagcgagcgagcactggcccttgcaatactacatatgccttccctgaggtacgtatgggttcagggctacaaagcgtctcaaaccggccgagacctcatgctcatggcaaggcccttctggaacatagagtttacacctcccaatcctaagaacggaggttggctgatggaagatggggagccttgtgtagatagtcacgctcagatacttgcataccactccctcgccggtaagaggctggactgcccacaatccgtggttcctttgtatcctgcgtgagtgtaaatagactaagctggtgtctttccttagcctcctggtcaacaagaatggtgttgataactcgatatatgcggttattgtatggatctagatggctagctgctacgtactgtaataagctactagtagctgagagatgtcctggaataagcccttgctatttttgcc

SEQ ID NO: 8865 - DNA, 909 bp, Zea mays
gttccttccgttccgtccgtccacttgccgttgccgaccacaacccgctcccggaggacggcgggatgagggggcaagccaacggagtggaggaccgccggcagcggggcgacgacgacggcgaggaggcggaggaagaggagggcgacgacgagggccgccaccggggccagggcccgccgcagcagcggcgccaccaggcccagaggccgaactccggcccgcagcagcagcagcagccgcgcccgccgccgccgctcgccaggaacgtcggctacgtcggcaagcatcgcctctccgccgccatcgcccgcctcgaccaggagctccagtccctccaggaggagctggacgagcttgagaccatggaatctgcgtccgcggcgtgccaggaagtggtcacgagtacggaagggaagcctgacccgcttcttcctgtcaccagtggcccggagaactcgtcttgggacaggtggttccagcgggtgcgctcccgcagcaacaaatggtgggcatcgaaaggccctgacttctcgtagctcctgcaaacaaagcggagaccatcctcaccagtcgtgtgcagattagaatgaaacacgttgagatgtatcgtccattggtgtcctggggaaacagaacaggcggcggcggcggcgagtgcggtgtggctctcgcaacgcttgatagtttttttttttttgagagaatcattgtgtatgtagtaatccctaacgaggccgaacatcgatgcatccacatcaaggcctggttgttgtgtttcctagagattctgactcactaggtcggattcctgatggtcatgcgatctcgctgttctttcttcaaacgtgaagaataacattgtctttgaaaagtttcaaaaaaaggagaatcagattgaacgttgtt

SEQ ID NO: 8866 - DNA, 1404 bp, Zea mays
cggacgcgtgggtcgacccacgcgtccgcctccagctagtagcagtagcagctagctagctagctagcaactggccatcggggctgctagcagcgtacgtacgtggcgcgatggctcctccagctcatgataggctccgccgcctggtgctgctcctcgtcgttgccaccgccgcggcggctttgcttctggcgccgacgacggcggatgctgcgctgccgcgggtgcagcacacgcccaccaaggccgacgggtcgctcgccatcctcgtcgtcggcgactggggccgccgtggacagttcaaccagaccttggttgcccagcagatgggcgtggtggggcagaagctggacatcgacttcgtcatctccaccggcgacaacatctacgacgacggcatcgccaacactagcgaccccctcttcaaggaatcgttctccaatatctacactgccaacagccttcagaagccttggtacctggtccttggtaaccatgactacacgggaaacgcgctcgcgcagctcgaccctgccattcgcaaagtggatagccggtacaccgccattgccaagtccttcattgtcaactcaggggttgcggattttttcctcgtcgacacaacgccgttcattgtccactactggaacaacaccaagttcgattggagaggcgtcgctcctcgagacacctacatcgcgaatctcctcaaggacttgaagtgtgcactgacagcgtccaaggctccctggaagatcgtcgtgggtcaccaccccatcagcagcgcctgcgggcatgggaacaacactgagctcgaggagttgcttctcccggtcctcaggacacacggggttgacatgtacttgaatggccatgaccactgcctgcagcgcgtcagcagcagagacagtcgtcttcagctactaaccagcggcggcgggtccaaggcatgggctggcaagttcaagcccaccctcgacaaggtggagttcctctacgacggccaggggttcatgtcgatgcgcctgagcaggacggaggcccgcctcgcgttcttcgacgtcgctggcagcgtcctgcactgctggaccatgcatgcccaaaaattaaagacgacgacgacgacgactgctgctgctgctgcagccgggcactaaagctttgctggatcggagttattaatgttcgttgctgcctcgcggcggtacgatgagttgatgatgcaattaattatttggttttgtcgtcttttcgtgcgtgagagggaagcaataataattatttgctgctgcttccgttgtgtgcacatgcatgtgagggtgtcaagtatgttcagcctcttgcaagataaaatctctcgtcttctatggaataaactgggaaaagagttttttttggtaaaaa

SEQ ID NO: 8867 - DNA, 1122 bp, Zea mays
cacaccagaccagctcatcatcacattcgcatacatctcttctagcacgcaaagatcgagctatatagctagctctgcaaccagagagaaggaggactatacccttcgccggccggcctaaggaggagtacgtacagaacttgggacatggaaaccgtcgtgggagacctcatggcgaccgagctgaggcttggcctgccgggcaccgtcgacgactgcagccagccccaactggtgaaggccacgccgccgtcgacgccaaggggcaagaggcgcgccaccgccgatgccgtggaggaagccgccggcgccgaggaggcaagcaagcgtgacgccgagacggcgcccccggcagccaaggcgcccgtggtgggttggccgccggtgaggtcgtaccggaagagctgcttccagcaggccagcagcaagcaggcggcggcggccaaacaggaggcggcggcggcggcgcccggctgcacggcatcgtcagcagccgccacaaacaccaccagcagcagcagcgccgccgtcgtcgtcggctccttcgtcaaagtgagcatggacggcgccccgtacctgaggaaggtggacctgaggatgtacaggggctacagggagctccgggaggccctggaggccatgttcgtctcctccagcagcgccaacaacctgtcggagttcgccgtcacctacgaggacaaggacggcgacctcatgctcgtcggagacgtgccgttcgagatgttcgctagcacctgcaagaagctgaggatcatgaagagatctgaagccacaggcctggggtcgtcgtcagcgaggcagcaatgaagatgatcccatctgatcgagaggacctgcatgcccggcaacgttgaacaacatgtcgatcgaacgtcatggtggccttattaattgtttctttcttttcttttcttccttttgtttaattatttttgctgttctggttggcgccgccgtggatcggagggatccccaagccgaaggatgagcttggctggcgcatcgaagcgcatgcaacggatgtgtgcggctttggttctgtaataggacaaccagtggtccttttttcgatctattagcggcacaaaaggagctagatgc

SEQ ID NO: 8868 - DNA, 1174 bp, Zea mays
cgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaatggctggtctc

SEQ ID NO: 8869 - DNA, 1420 bp, Zea mays
caacccaacccattgcatttgcaagcccttttacattgcagagcgccagagcctcgctcgctctcggaacagagctaggcagctaacagacgaagaagaagcaagccaagcagaattgagagagaggcgaggacgtggcgacgacggcagccgcgatggcgacgacgacggacctggggttcgaggcgacggagctccgcctgggcctgcccggcgggggaggtggaggggagccggcgctgggcggcgaggggaggagctcttcctccgcctccggcaagaggggcttcgccgagaccatcgacctgaagctgaagctggagccagcggccgtcgtggaggcggaggaggaggaggaggaccacggcgttgctgttgcccttgagaaggaggaggaggccgggaagatgaagcggtccccgagccagagcagcgtcgccgccgccgccgccgccgtgctggctgaccccgccgagaagccgcgcgccgccaaggctcaggtggtgggatggccaccggtccggtcgttccggaagaacatcatgtccgtgcagtccgacaagggcgccgccgccgccaacggcgacaagtcctcgccggcggcaggcggcggtgccgcgttcgtgaaggtgagcttggacggcgcgccctacctgcgcaaagtggacctcaagatgtacaggagctaccagcagctgtccaaggcgctcgagaacatgttcagctccttcaccatcggaagctgtgggtctcaagggatgaacggcatgaacgagagcaagctggtggatctgctcaacggctccgagtacgtgccgacctacgaggacaaggacggggactggatgctcgtcggcgatgtgccgtgggagatgttcgtcgaatcatgcaagcgccttcggatcatgaaaggatcagaagccattggcctggcgccaagggccatggagaaatgcaagaacagaagctgaggagaagacggacggacggaagcttgcatctcagcaccaccaggggtggatggatgcaagaagaacaaatctccatggcttttgcagctctgctcgtctctgtatcatactcgtcgtccctgcccttcaggcctctgtatctccctgatcaatgaagtcgttttggtgtgtcaactgttctctccgtgcccagcttgtcagtgaaagagtcagtcagtgtccatcaagtctcatcttgtcctatacagaagagagaagccatgcatgaacatgtacctgtcctataacaatgtctttttttgctacctgtttttttttctctctctctctttttttggcacaagatgcaaaggcaccctgctcctgatcaaagggccttttgcatcataagctgtttgattataattaccatggtgtgtcagtggaacaaataactgttgcaaggtgtt

SEQ ID NO: 8870 - DNA, 1148 bp, Zea mays
caagaagccacctcaggctcacgccgcggttccacacgagcaaatcccgccgcttcctccccacgcaccccttcccatccttcccgaagcacgaggcgagccgggccgccggatatggcgccggcggcgccgtacggcggggccgagtcgcagcggcaggcggacctactcaagcaggagggcaacgcctttttcaggaaggaacgcctcagcgccgccatcgacgcctacaccggggccataactctttgcccaaatgttgcagtatattggaccaaccgagcactttgctataggaagcggaatgagtggactagagttgaggaagattgcagaacagctatccagcttgacagccagtctgttaaggcacattacatgctcgggttatctcttgtcaacagccaaagattatcagaaggaataaaatcactggagaagtccttggagcttggaaggggtgcacatcctgcaagctacatggttgaagagatatggcaggagctttctaaagcaaaatacatcgaatgggagagcttatcaagagaccgaacttgtcaactgcaaaagctgaaggtagcatgtaaagaggccctaacgagttacaacagccttgataacccagccgcaggtgcgccagtagaacagctaaatgagctcgaggaagttttcaagaaggctgcaaagactgatactccagcagaagtacctgaccatctctgttgcaaaatcacacttgatatcttcagagacccggtgatcaccccgagcgggattacctacgagagggccgtacttctcgaccaccttcaaacggtggggaggtttgaccccgtgacccgtgaggctcttgaaccgcaccagctggttcctaatcttgccatcaaggaagctgtgcatgcgtttttgagtgagcatggttgggcttacaagattagatgatcgctttggaatacaggttttggatactgtcggatgtgacggtgggatttttttgttcactgttggggggcagattttaatctgggatggctgcgtacagattcaccttctccagttgtgtacatatgagatgctcattatgatagtaattgtgaacagtacaccaaaggaagtgaagttgagcgtctgaaaaaaaaaaaaaaaaa

SEQ ID NO: 8871 - DNA, 2100 bp, Zea mays
atgccgctagttccgtcccactccctcgcttcccatcccgcaccccatggaagggagcagcactagctagcgtgggacagggcggggtggtgtcgtggtgatggaagcgggcggcggcgcctcggaactcggcctgctcggcgccggatctggcaggctgctcaagcacgggcggggcgacgcggcggggggagaggaccacgggtgggtcgtcgtcgtcggcggcggcggcagggccaagcaggccaggaccgcgtccgtcggcaccggggacgcggcggccacggcggccgtgccgttcctgctgggctcctgcggcggccccggccacggcggggaacggatgctcagcttctcgtccgccgccgccgccgccccggatgatggcggtgccatgccgccgctgtactacgggaccccggcctcttgctcaggattgatgagctcggcgagggtgagaggccccttcacgccgccgcagtggatcgagctggagcaccaggccctgatctacaagtacctgtccgcgaacagccccgtacctcacagcctcctcgtccccatcaggaggagcgggagcctcgcatcgtctccctacccgcctccctacttcggcacgagcacattcgggtggggctccttccagctgggctactccggcaatgcggatctggagcctgggcggtgccgccggacggacggcaagaagtggcggtgctccagggacgcggtcgccgaccagaagtactgcgagcgacacatgaaccggggacgccatcgttcaagaaagcatgtggaagaccagcctggccatgccgcgaaagccatgtccgcggtggccgtggcggctgctgctgctgctgctacccagcatgctgctgctctggccggcgccggagctactgctgctgctggcctcgctgtcaatcggcaccggcagccggggaagagctatgccacgggtgcgactgatccatgctctctgcaatatagcagggaactggcgaacaaactgtcgaacgagagcgaaaacatgcaggactctgacaatgtctcgatgctgacttccatgaacacaggaaacactgcaggcagcgtgtttccgttctcgaaacagaacactgctcttttcgaagtgagcagctcaaggccagagtttggccttgttccatcggattcactgacgagttcacctcatagttccttgaagagtgtcaaaaatctgctcagctcacggagtctgagtgagcaccagagctccgcctccctgcaacactttgtggactggcccaggacgccacctgcccagggaggtctttcatggcccgaggcagaggacatgcccagagctcagaggtcccagctctcagtatccgctccaatggcatcctccgagctatcatcggcctccacatctcccatccacgaccacgagaagctgattctgtcacctctcaagctgggccgcgagtataccccatctggcgtcgtcagcgctgcagcgaacagatacgaggttagccagctagaagcgacctgggcgacgatgttccgcgactcttcgacgggcggcccgttgggggaggttctggccaagaacaacagcaacgcggaagcaagaggttgcccgtcggcggcgccacctctaaccgactactactgctgggattcaggccacggcatgcagtcgtcccccgtgggagttctgcagaggacgaccgccttcggatcggtctccagcagcacgggcagcagccctagggtcgagagccacggcgcctgctgcgatggtaccagcaacctgatggatgatgatctcggctcagttgtagtgagccaccccagcatccgcctcttgtgagcccgctgagttctggccatggaaaaagcgtgaggggttttgtcatttgagactgatctgtcacttgagttcttcttttgtttccttttaacctggctttgtaactctcaccttctttggatcgtgaaaagcgctgcgatgtgtggtgtggctgggtttttggtgcgccgttgatgcgtagtaccattcatataaaagccagtatccgaccgatcggtctccgtctgtctgctgaaaaa

SEQ ID NO: 8872 - DNA, 1434 bp, Zea mays
ccggccaccagcgccggaggccgtcgtcgtcttactagccgacgctcgacttgggcatgaattgctagccgcgcgggtgagagattgctaggtagccagctaggtacggtgtggggagttgaatcggaggtctgccgctcgaggcggcggcggcagaaggccggtaggatgaagaagctccactggctggtgcggttcctgttcgggccggtgccggtctacttctcggcgctggccatcctcatcgtgctcaccaacgcgcagtacttcgggctggtgggcgtcggcgtggcgccgcgcaccgcgaagctggcctcctcggcgcccgtggtcagcgtcatgaagtactgcgacatcttccgcggcgagtgggtgccggacgcggaggcgccctactacaaccacaagacgtgccacatgatccaggagcaccagaactgcctcaagtacggccgccccgacctgggcttcctcaagtggcggtggcggccctccggatgcgagctgccgcgcttcgacccgctgcagttcctgcagttcgcccgcgggaagtcgctggccttcgtcggggactcgctggcgcggaaccacatgcagtcgctgctctgcctcctgtcccaggtggcgtatcccaaggacctgtcggcgaacccgtcggaccagaacaaggtgtaccactaccgggcgtacaacttcaccatcagcatgttctggtcgccgttcctggtgcgcgcccgggagcccgaccacgacggccccgcgcacacgggccactggagcctctacctggacgagcccgacgacaagtgggtgtcccagatgccccgcttcgactacgtgctggtgtcggcggccaactggttctcccgcccctccctcttctacgagcggcggcgcctcgtcgggtgcagcttctgcagccgccagtacggcgtgcccgacctgacgctctactactcgcagcgccgcgcgtggcgcgtggcgctgcgcgccatcaacgacctggagcgcctgcgagggcgcgtcatcgtgcgcatgctctccccgatgtcgcacttcgagaacgggacctgggaccacggcggcgactgcaggcgcacgcagccgctgcgggcgaaccagaccgccatggagggccgcgacctgcacttctacaccgcgcagatggaggagttccgcgccgcggagaaggccgccgccgagaaggggcggcgcctgatgctcatggacgccacggcggcgatgctgatgcggcccgacggccaccccagccgctacgggcactggcccaacgagaaggtgcagctctacaacgactgcatccactggtgcctcccgggacccatcgacatctggaacgacatgctcttccagatgctcctcgcctagcagcaagcagcaaagattaaaaaaaaaactcagcaattcggtcgc

SEQ ID NO: 8873 - DNA, 1980 bp, Zea mays; identical to SEQ ID NO: 8022

SEQ ID NO: 8874 - DNA, 961 bp, Zea mays
gccccagcagagctcatctctgcctcctgtgtccttctccatgacagagaatctccactccaggaaaatggtacagccaaagaagtttcgtggagtccggcagcgccactggggctcctgggtctctgagatcaggcatcccctccttaagaggagggtctggctgggtacctttgagacggctgaggaggcagcgagagcatatgatgaggctgctgtgctgatgagcggacgcaacgccaagaccaacttcccaatccaaagaagcagcacaggggagcctaccccagctgcgggaagggacgcccgcagcaacttcagcagcggctcctctaccaccaacctgtcccagattctcagtgcgaagctccgcaaatgctgcaaggcgccatcaccgtccctgacctgtctccgccttgaccctgagaagtcccacattggtgtttggcagaagcgtgcaggagcccgtgctgactccaactgggtcatgacagtggagctcaacaaagatgcagcatccactgatgctgcatcacagtccacatcagcaacaactgctccaccagccacgccgatggatgaggaggagaggatcgcactgcaaatgatcgaagagttgctgagcagcagcagcccagcttcaccctcaaacggagatgaccaaggtcgcttcatcatctgaaaagcatggatcaaacagcacaagtcaccatcccagatcagagtttcgctaggtcggttggtacacaagcagttcaggttgcttcagtaatatagatatatgtctattactaaatccaacttacaagaactataaagtttgcaattgtgtgcagttctatgtacgtgaaaagctctacatacacatgttcctatcaagatactttgttacacatcaatgtcagtgatataattgcttataaaagaaataaatagattatgattgtgttactgctaaaaa

SEQ ID NO: 8875 - DNA, 878 bp, Zea mays
gcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgccatattatgattatgcacttgatctcatcttagacattgagtcttctaatgatgacgggtttaccgaggagcaaaatgaattaatcgagtcatctgcagagatgctgtacggtttaattcatgcacgatacattttaaccagcaagggtctagctgcaatgttggagaagttcaagaactacgactttggtagatgccccagggtgtactgctgtggccagccctgccttccagcagggcaatcagatgttcctagatcgagcactgtgaagatatattgtccgaaatgcgaagaacttaactatccaagatccaagtaccaaggcaacatcgatggatcatactttgggacgacattccctcatcttttcctgatgacttactcgcacttgaagccgcagaagccgtcacagcaatacactccaagggttttcggcttcaaacttcacaagccgtcatgacagagttgtagcttcccccagaagcccccctgtcccctaggttttagggagagcatcgtggccttcaaatactgttgtattattgatgtacgaattcgcgagcctgggcctcgctgtaaactattgtgaaattgtatctgttttccgatattattactgttgtgtaaccttggttctctctcactcgctt

SEQ ID NO: 8876 - DNA, 1248 bp, Zea mays
tccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctacttcgaccgcgacaacgtggctctcaaaggatttgccaagttcttcaaggaatccagcgacgaggagagggagcacgctgaaaagctcatggagtaccagaacaaacgtggaggcagggtgaggctccaatcgattgtgacgcctttaaccgagtttgaccaccctgagaaaggagatgctctgtacgctatggagctggctctggccctggaaaagctggtcaatgagaagctgcacaacctgcatggtgtggcaacaaggtgcaatgatcctcagctgacagacttcatcgagagtgagttcctcgaggagcaggtggaagccataaacaagatctccaagtatgtcgcccagctgaggagagtgggcaaggggcacggggtgtggcacttcgatcagatgctgcttgaggaagaggcctaaaaagaagaacggacagatgaatgaaggaaacaagtgtgtaatgttgatcaggcggaggaataataatgggtcaactgacaactctgggtcggtggatttgtagttggtttgggttttttagttgtagaacggtgttgccctcctagagagggatgaacacattatgcatgcgatgtgtcagttcggtcggtgctatgctcgttgggatttgattgtcggaaataaaacatgggtgatgaatgtgtaccctccctaatctatgaagttgagaaagccctgcgggtgtaggtggatttgtagaggtttttcttcagttggttaggttcgctgttgcctacctcatttgcccctaatcatcatcgccgtaatttatttataataaaaaagatccagcttttccccctct

SEQ ID NO: 8877 - DNA, 1186 bp, Zea mays
aaggcactgaagaagccagtcaatagcgagttctactactagtagctagcctgctgatctgttctgttgtttagttcgcaaagccttctgtttcggcgaccatggaggatgagaggaacacccagcagcaccagggcggtgaggcccagcaggacgccgccgatcaggtggacgtgaaggatagggggctcctggacagccttctcggcaggaagaagcacgacgacgaccaggagaagaagaagcagacggatgagctggcgaccggcatggagaaggtcacggtgtccgagcccgagaagcacgggcacaaggaggaggagcacgaggtcgtcggcgagaagaaggagggccttctcgccaagctgcaccgcaccagttccagctccagctcgtcgagcgacgaggaagaggaggccacacggccgcgcccgtggagacgcatgcccaccaccaggaggaagcgcacaggccgcacgtcgtcccgaccccggccccgccgcctccaccgcacgtccaccagcacgaccacggcgtcgtcgtccaggacgacgtgaagaccgggaccccgccgcatgcaccggaggaggagaagaaaggcctgctggacaagatcaaggagaagctccccggtggccacaacaagaagcctgaagccgctgccgctgccgcaccggctccgcccgtccacgcgccggcgccggcgccgcaggcggagaacgtgagcagcccggatggcaaggagaagaagggcggcttgctgggcaagatcatggacaagatacccggctaccacaagagctcagctgaggaagcagaccacaaggcggacgccgccggcgagcacaggaccagctcctaaggtcgcagtcgcagcgcgtgtcctggccgtggccgggccttgggcgatcagaaggtagctagcgttggcatgtgggttcggttctggtttgcttttaccaaaagtttgtttcaaggtggatcgcctggtcaaggtccgtgtgctttttaaggtggatcgcgtgactggcagtgagtgttgctgcttgtgtaggacgtggtacgtacgggttttattttggttccaagtcaaaagtcacggtcggtctggatgttgtgtactgggtttgttgaattatgagcagctgcgcgttgtaattcggctgggctacctggatgcgttaat

SEQ ID NO: 8878 - DNA, 1891 bp, Zea mays
gctcgtcctgcttcgtactaccagtagtagcacgtaaaccagggcgccacgccagccggatcggatcgtcttggatgtgggcatgtggctgtggacgagacaaaagtctccgcccgtcggccgtcgcccgccaaaggtctcttcgatccggcctctccgggccacccagtcggccagtcccacacaaggatggatcgctagcgccgatgagctatactctttgctcactgtactagtcacacgattggctacacgacacgagctcagagctctcaggtttcccaacgccggctgctggccaatggcgcagcaccacggcagccactccctggaggtcggcggcgtcggcgccggcggcgtcgagctcgacgacgacggccacgccgcgcgcaccggcaacctatggacctgcttcgcgcacatcatcaccgccgtgatcggctgcggcgtgctggcgctctcgtggagcgtcgcgcagctgggctgggtgggcggccctgtcgccatgctctgcttcgccttcgtcacctacctctccgccttcctcctgtcccactgctacaggtcccctgcctccgatgatggctccctgaaacgccagaggaactacacctacatggacgccgtcaggacgcacctgggggagaagcgcacctggctctgcggcctgttccagtacctcaacatgtacgggaccgcaatcgcctacaccatcaccacggcgacctgtctcagggcgatcgtgagggccaactgctaccacagccagggccacagcgctccctgcggcgccggcggcgaccacctctacatgctgctcttcggggcggcccaggcggtgctgtccctcatacccaacttccacagcatggcctggctctccgccgtcgccgccgtcatgtccttcacctacgccaccatcggcctcggcctcggcctcgccaagaccatagaaaatggggcgatcaaaggaagcgtcgccggagttccgatgagcaccgcgccgcagaaagtctggcgagtcgcgcaggccatcggcgacatcgcgttcgcctacccgtacaccattgtcctactggagatacaggacacgctcaaatcgccgccaccagagagcgagacgatgcagaaggggaacgtgctcgcggtcctggccaccacgttcttctacctcgccgtggggtgcttcgggtacgccgccttcggcaacgctgcgccgggcaacctgctcaccggcttcggcttctacgagccgtactggctcatcgacttcgccaacgcctgcatcgtgctccacctgcttggtggctaccagatgttcagccagcagatcttcaccttcgcggaccggtccttggcggccaggttcccgaacagcgcgttcgtgaacaaatcctacgccgtgaaggtgcccggcgcgccggcgtcgtggagctacagcctcaacctgcagcggctgtgtttccggacggcgtacgtggcgagcaccacggggctggccctcctcttcccctacttcaacgaggtgctgggcgtgctgggcgccgtcgtcttctggcccctcgccatctacctccccgtcgagatgtactgcgtccagcgcggggtcctgccgtggacgcggacgtgggtcgcgcttcaggcattcagcgtcgtctgcttcgtcgtcggcaccttcgccttcgtcggctccgtcgagggagtcatccgcaagaggctcggctagttgtggtattagcgccttttctgtcgtcaaccatgtcatgaatggtggaagtgtgtaaagagagtgtactgtatctaagttttttttatttccctgtgttcgcttagccatgagcccatgaccatgatgattgatgaatatatctacccgtgcgtgtttagatcc

SEQ ID NO: 8879 - DNA, 1304 bp, Zea mays
gttcgtgtggaggggagaagacaggaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagttgctgagcatgctgcagcaaataacaaggtgttcctgatgaacctctctgctcccttcatctgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcgactatggacgtctcctttgtcgctgtataaggcatgatttgccatcattctgttgcttcggtgatgcttgcaatgcaatgagaatgtgttggaacgat

SEQ ID NO: 8880 - DNA, 1459 bp, Zea mays
cgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactacaagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaact

SEQ ID NO: 8881 - DNA, 1284 bp, Zea mays
cttttggttattttcctcttgctgtggcttaacttgacaagaagaagatgctacgtcggcaaggccgaggtggaaaatttctggaggaggtgctcatcgtcggcgggctcctgctggtgcagtgcgtgctctccggctacgtggtcttcaccgaccacctgctcgccctcggcgccgacccgctggccgtcgtcgtcgtcgccggagccgcctacgccgccttctgctttcccttcgccgtcgccctcgagaggaagcgatggccttccacggtttcggggactctggtggcgcaatacctgctcattgctcttggagggacaaccgcgtttcaagcgctgatgctgctggggatcaagaagaccacgccggccatcgcatccgccatgcccaacctcagccccggcctcatcttcatcgtcgcagcctgtttcaggctggagaggttcgacagggcgtgcaagtacacgcaggcgaagatggcggggacggtggtgtgcctggcgggagcgctggccatgggcttcctgcacagcccaacttctacctcctcctctctgcaggcggcagtagctgcggaagcagcagcaggagggggcgactactactacgactggatcctcggctgctgctgcctcgtcgccgccgtcaccgtcttcgcgctcgtcaccgtcctgcaggccgccacgctcgccgccttccccgcgccgctcaccatgtgctgcgccacctccgcgacgggcgccgctctcaccgccgtcctgcggctcgtcctggaagggaggttcctcggcatggggtcgcccaggatcgacgccacgctcgtcgcggggatcgtcgtcctcggcggggccgcggtgggcgcgtgcatggcgttccaggcgtggtgcctgggcaggaagggcccgcttttcgtctccgtcttcgggcccgtccagaccgtctgcaccgccatcctctccgcggctctcctccgccaagtcctcagcctgggaagcctcgcagggatcgtgctcatgttcactgggctctacattgtcctatgggccaagagcaacgagatctcggctgacgacgaggaacagtcgttgcagggtggcgacgacgccgagaaggcactcctagcctagcctagcaaaatccagagcgaatatcactgcacgctctgtatttgtaaaaatggaatggtgtctacgtacctgtatacatactcgagaggatttagagaaaaaggacatggctacgtttgttcataatatgtatatactggaaatactccctccc

SEQ ID NO: 8882 - DNA, 1280 bp, Zea mays
gaaatggcggcgactgagggcgtgctcttggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagttgctgagcatgctgcagcaaataacaaggtgttcctgatgaacctctctgctcccttcatctgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcgactatggacgtctcctttgtcgctgtataaggcatgatttgccatcattctgttgcttcggtgatgcttgcaatgcaatgagaatgtgttggaacgat

SEQ ID NO: 8883 - DNA, 1253 bp, Zea mays
ggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgatttctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaagg

SEQ ID NO: 8884 - DNA, 2951 bp, Zea mays
gagacagattccacagcaatttgctcctcttccacgcacaggcaagactgctccccagaaaagattgtagttttcatcgatttagccggtttctgcccgggggatcgctgctggagatctcagagaaccgggaggctccgagcttttgctccgtttgcgtcgaatctgcctcgggagcggagaaaggagcggccttccgagctcgtaggggccgtccctgagaaggcgagaggggacgcggcggcggcggagtcagctctagggcgctcgtggaagtcggtgatgccggtggtttgaggacgaggcggcctcggtggttttgaggaagccagcctctgccgcggcaaggatggactccagcggggaggaactcctgaagaagatccgggaactggaggttgggcaggcgcagctcaagcaggagatgtctaagctaatacccggcgctggggagcgtcggcgctcgcaatccgtctcgccgcggcgcggcgtgccggtgccgccgccaccgccggccaaggcgaaggcgggggcgccaggtaggcggctgtccggggggtttgagggcgggcagcgcgcgtgggcccgtgggtcggcgtctttcccgcactcatcaccgctgcagcgggagggccgcgcaacgggcgctggagacgctagcaccagcgctaggctgccggagaggcagtactccagggtgcttcagtcaatggggcagtccgtccacattcttgacctcgacgggaggatcatatactggaatcagtctgcggagaatctgtttggctatcctgcatcagaagcccttggtcaggatgccctcatgcttctggttgattcccatgaccacaatgcggtaaataacatcttccaacgtatttctatgggtgaaagttggactgggaagtttccagttaagaacaagcaaggacatagattttcagttgttgccaccaatacacctttctatgatgaagatggcagtttgatgggtttcatttgtgtttcaagtgattcccgccaattggagcagatattttgtaagcctccgacctctgcaaggtcccagtcagaatcatctatgacatcttgtgatgggagttgcagcaacactagtcacagaatcaattcgttgaatagaagttcttttgattctaatctacccctgcaaagcactttagcatccaagataacgaatttggctaccaaggtcacaaataaagttcgttctcgggtcaggacagacgagaatggcgatggtggcagtggtgagagccattgcttggatcgtggtgcaaaggaagagccaacatctagcggaacaagcacaccaagaggggatgcaccacatggtccctttgctacagaagagaactcacctgggaaatcaacgaacccaaacagcgacgaatcagaaggaaaagtaggtctgcacaagattttgggttctaaggcagaggcactattgaacaagaaagggatatcatggccttggaaagggcgcgagaatgagggacctgatgaaagaaaccatgtgatattgccgtggttgcatggtggccaagagaatggtgtgaatcatcagaaggtttctgattctagtatatctccagacgcccaaggcgctgaacacaaccaacctagcaaaaatgaggcatcaggttcctggtcctctttcaacaataacagcacaggcagtgcaagcagcacgggaagcactaatagcagtgctctctacaaagtagatcatgaagcagattgtctggattatgagatcctgtgggaagaccttgtcattggagaacaaataggtcaaggctcttgtgggacagtatatcatgctttgtggtatggttcggatgtggctgttaaagttttctccaagcaagaatattcagaagaagtgatactgacctttcgacaagaggtatcccttatgaagaaattgcgccatcctaacatactgctcttcatgggtgcggttatgtctccacaacgcctttgtattgtatcagagtttctcccccgtggaagcttgtttcgcttacttcaaaggagcgctaccaagttggatgtgagacggcgtgtccacatggctttagatattgtaaggggcatgaattatcttcaccattccagcccgcctatcattcatcgagatttaaaatcatctaaccttttggtcgacaagaactggattgtgaaggtggcagactttggtctttcacgtctcaagcgtgaaactttcttgacaacaaaaacaggaaaaggaacaccccaatggatggcgcccgaggtgttgcgcaatgaaccttccgatgagaagtctgatgtgtacagttacggggttatcctgtgggaacttgttactcagaagataccctgggaaaatctgaactcgatgcaggtcattggtgcagtgggttttatgaaccaaaggttggatatcccaagtgaagtagatcctcagtggaaatcaattatcctgagctgctgggaaagcgacccgcagcaacggccgtcgttccaggagcttcttgagaggctccgggagctgcagaggcactacgccatccagcaccggaacacaaagaacagcatcgaggagtgaagaacacaatgcgactctcagagcgctgtggcttgcttcgaagcattttgcgagcgaacgaacgaagaaccaggtctctagaagggcctggaccctcctgtactgtatggttttgctttggcggaacagccaaggctggaagaagtttgttgtacagacgggggtacgttcttctttgtttgacagggcaattgtgactgtaatctctgggtcctaacacccaagggtagggtagagactatagagtgagtagtgactgagctccggattgctggcgcatttgggttcttctgattcgtggcaatgcaaatgcgtggttaacaataacatccaaaaaaaa

SEQ ID NO: 8885 - DNA, 787 bp, Zea mays
cctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgatcttagactcccaactgatgagactcttgtggcccagatcaaggaagggtttgaaagtggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatgtcaaacacaagtgcagggatcgctgggtgttgcaccgtgtctgcattatctgtggttacattctggaccctgtattttctatgcttttatgcccctactgtttagtattaattatcaataaatttgtttgggacggttg

SEQ ID NO: 8886 - DNA, 1513 bp, Zea mays
ttttctctccacaccaggccacgccacacacaggatagcgagcgggagcgacggcggcggcggaggagctagggttttgatccggcctcgccggctaggctgcgccgccccgacgccgaagccatggacagggagcttctagagacgtttgacgtggccaagaaggcggccgacgcggcggcaggggacggcaactcgccggaggctggccgctgcctcgacgcgctgcggcggctgcgcgacattcgcgtcaacaccgacatcctcgtctcgacgcaggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggcgaggcccgtgaagattgaaaagaactctgtttcagcaagcatgaagcttgagaaaagagatgtggatgttaggggtcagaagcctaacaatgccaaagttgagaagactactagtaatggttccaaagctcaatctgtgaaggtggaaagggtatccaaagaagtcataaggactcctgacgcaaagaggccagcatccgtccccaatggccacccaaagcttacatctcttgtcaaatgcaatgatcctacccgagataaaatccgggaactacttgctgaagcctttgtaagggtttccagagagactagtgatgatgacagagacgaagtgaaaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaagcaataccgatttccggaggagggtcctcatcggtctagtggcgccggagaggcttccagacgtatcccccgatgagatggctagcgacgcaaggaagcaagagaacatgcagatcaaggagaaggctctgttcgactgcgagcgtggagcggcaccaaaggcgacgacggaccagttcaagtgtgccagatgtgggcagcggaagacgacctactaccagctgcagactcggagtgctgatgaaccgatgacgacgttcgtcacatgcgtgaactgcaacaatcactggaagttctgctgagtgttcagccttgctaaagtgtttacttagttgtgctgactgctgagcacactatcctgctgtgatgtgtgtgctctgttagttgtgactgtaagttcgacagagcaggctgaacaactcaccttttttccccttttttaccccccgtaaactaggagcagttatcctcttcctctgtcaggcagcctcctgattcattcagattgtactagtcgaacgcgtgaatgttgttgacttgatcgcatcgtcaccagctgtgaatgttcttgggtggagttagaat

SEQ ID NO: 8887 - DNA, 1023 bp, Zea mays
tccgacggccccgcgcgcgcgttctcacccgaccctgctcttcgcctcggctgctctaccagtctacctctaccccgcgccccctccgagatcggaatcgcggcgccccgccgccctcctccgccatggcgccgtctctgctcgggggcttcaccaagtcgctggccatgacggtgctctccgaggtcggggacaagaccttcttcgccgccgcgatattggctatgcgccatcccaggaaactggtcctggcaggctgtttgactgcactaatagtgatgacagctctatcagcttctctaggttgggttgcaccaaatctgatttcgcgtaaatggactcatcatgtgaccactctattgttctttgtatttggtatttggtcattgtgggaaggcttcaaggaagatggagattcagaagaattggctgaagttgaagcagagctggatgatgtctttaagagtaataaaggcgaatctaaaaataaaactaaggcaaacgatgatacgaagaaacagcaaagaccatttctcatgcaattcttctcaccaattttcataaaggcattttctattacattctttggtgagtggggtgacaagagccagattgctactattggcttggctgctgatgaaaacccatttggtgttgtcctgggtggaatcatagcgcaagcactctgcactactgctgctgttcttggtggaaagagcctagcctcccagatatccgagaagatggtcgaactgtcaagcggagtgctcttcctgctgttcggtatcatgtcattgctctctggaccaggagaattgtaatccctgcttgaacccttttcagctggctgattgacatctctctctccttagacctatcttatttcagtagatgaatgatggcgacaaaagccatccatccatatggcgaaccggatggtgattcgatagtttagccgacacatcggaaacatttcactcgtccttcataaataactacatgttacagaagtctagcgatttc

SEQ ID NO: 8888 - DNA, 1113 bp, Zea mays
tccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattagtttgctttgtgttgccgctagtccatgtggactggtattgttcccctggatttatttggcaagcgtgtccgtgctcgctctagcgttttattgagcttttaaagtcatcgcattcttttttgattgc

SEQ ID NO: 8889 - DNA, 707 bp, Zea mays
ggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttttggagctggccgggaacgctagcaaggatctgaaggtgaagcgtatcacccctcgccacctacagttggccattcgcggagacgaggagctggacaccctcatcaagggcaccatcgcaggtggaggcgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacactgtttgtgttgagttgttaacttcaagggtgcaaacctggataattatttagttattatatgactatctggtatccggtt

SEQ ID NO: 8890 - DNA, 838 bp, Zea mays
gctagctagcgttccctcttcttcacctcactaacaccagcagctcgatcgctctgtcctgcaataatggccgctcgctcctcctcccagcagctggtcgcggcggcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgttgactgcaccaagatcaactgatcgatggaccgtagtggaggtagctatgcctctgcatgctcgttggatggcagcgtggccatcagcagcatgcggtcgtcgtcgtcgtcctagcagatgtcctagctacgtgtgtgtcctcagactggcactgtggcacataataaagaagtagatcatgcacccactagtcatcacttcgtctagtccctccgttcgctgtcgtcgtcgtcgtcgtcatcgtcgtcgtcgtgtacctcgtacgtgacatgccgtagcacgtacgctagcagagcagcacctcaatgtccttgggtttgctttgctggctctctgttttcgtcttgtgttgcttttaatctggcacaggtttctaaattataataatgaatactttttgttc

SEQ ID NO: 8891 - DNA, 674 bp, Zea mays
gaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgtgctgtagcatgctcgtgtctagatctgtggatgggatgtgtcctgctctagtttcgtccttgtgtcttattgtatgttcgtcttcatcgagaagatcttcagcaatcagagctcgttgtgtact

SEQ ID NO: 8892 - DNA, 1020 bp, Zea mays
accgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacacagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgagggcgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggtggcggtggcgtcggcaacggcggcaccaagcgagcccgcccatcatagctgcgacttttagtgatgtaaactgcttagaaaaactgttgcggacatagcgcccatcatagctgcgactttttaaatggtggtgtaaacttttgtagtgcgactaggccgtttgtcaccctatcatacttggcttcaagtaggttttctgtttttcagttttcattatcat

SEQ ID NO: 8893 - DNA, 823 bp, Zea mays
cttcacctcactaacaccagcagctcgatcgctctgtcctgcaataatggccgctcgctcctcctcccagcagctggtcgcggcggcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgttgactgcaccaagatcaactgatcgatggaccgtagtggaggtagctatgcctctgcatgctcgttggatggcagcgtggccatcagcagcatgcggtcgtcgtcgtcgtcctagcagatgtcctagctacgtgtgtgtcctcagactggcactgtggcacataataaagaagtagatcatgcacccactagtcatcacttcgtctagtccctccgttcgctgtcgtcgtcgtcgtcgtcatcgtcgtcgtcgtgtacctcgtacgtgacatgccgtagcacgtacgctagcagagcagcacctcaatgtccttgggtttgctttgctggctctctgttttcgtcttgtgttgcttttaatctggcacaggtttctaaattataataatgaatactttttgttcattat

SEQ ID NO: 8894 - DNA, 842 bp, Zea mays
tagctagcgttccctcttcttcacctcactaacaccagcagctcgatcgctctgtcctgcaataatggccgctcgctcctcctcccagcagctggtcgcggcggcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgttgactgcaccaagatcaactgatcgatggaccgtagtggaggtagctatgcctctgcatgctcgttggatggcagcgtggccatcagcagcatgcggtcgtcgtcgtcgtcctagcagatgtcctagctacgtgtgtgtcctcagactggcactgtggcacataataaagaagtagatcatgcacccactagtcatcacttcgtctagtccctccgttcgctgtcgtcgtcgtcgtcgtcatcgtcgtcgtcgtgtacctcgtacgtgacatgccgtagcacgtacgctagcagagcagcacctcaatgtccttgggtttgctttgctggctctctgttttcgtcttgtgttgcttttaatctggcacaggtttctaaattataataatgaatactttttgttaaaaacc

SEQ ID NO: 8895 - DNA, 2535 bp, Zea mays
gcagtagaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgccggtggggaggcggagggtgttcgtgcagacggagaccggctgcgtgctcggcatggacctggaccgcggggacaacgcgcacaccgtcaagcgccggctgcagctcgcgttcaacatgcccaccggcgggacctcgctcaccttcggcgatcgcgtcctggagaacgacctctccttcttacgcccggactcgccgctactgctcacccggaacagcatcaaccggagctgctccaccccgtgcctctgccccgtctccaaggacttcgagcacaaggactgcagcggactggttgagatgctcggctgctccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgctcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggagcttatgtgtatggaggccaggaagagagtagcagagtgggagcccttctctgccacagctgaacatggagaagataccgatttccagttctcggtggatatgctaggagaatacagtgatgtagtgcgatcaccaaggttcaatggctcaggttccaaagtgtccagtttcagaagccctttgtctaagctcgtcgagagcgtcgacgagggcagtgatggccatgaagatcaaaacgagtctgatcgagtcttgtatgctggatggaatacatctagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagagacactgcacgagagcgcaagggcagcagcaggtcaaaggatgaagcagcggctaggcacttcatgcaagttttgagcagggcaatagcgcatcagagaagaaaaaatatgcagtgctacttgtattgcttgcttatggagtgagtacaggatgaagatatcatcgtatgcggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaatgtttgtcagcctgtgtatattggcttgatgttagatactccagctttagcatgcaatttcttagtcgctgaaaattctttgtagcttgtgatgtgacctgtgagcagtgtaaacattgcacctttgatggaaaaataatgcttacctgttgttgaaaaaaaaaaaaaaaaaaaa

SEQ ID NO: 8896 - DNA, 1531 bp, Zea mays
cggccggactcttctgacttggcaaccgccgcgcagcgcgacgagcgccacctgcttgctgccgcgtgcctgcgtgcgtgtgcgtccaccactgaccccgcgcccgcccgccgcccctgcccctccactccacttgctcactcgtcggctcgtcgcggcccgcttcccccccggccaagggatggacgcgcttcgcctacggccgtccctcctccccgtgcggcccggcgcggcccgcccgcgaggcagtggtagctgcccttttcatgaatatctatattgttggactgaaccagttattcgacattgagatagacaaggttaacaagccaactcttccattggcatctggggaatacacccttgcaactggggttgcaatagtttcggtctttgccgctatgagctttggccttggatgggctgttggatcacaacctctgttttgggctcttttcataagctttgttcttgggactgcatattcaatcaatctgccgtaccttcgatggaagagatttgctgttgttgcagcactgtgcatattagcagttcgtgcagtgattgttcagctggccttttttctccacattcagacttttgttttcaggagaccggcagtgttttctaggccattattatttgcaactggatttatgacgttcttctctgttgtaatagcactattcaaggatatacctgacatcgaaggggaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggtaccccacgctgcttgatgatatcccatgtgtccgggtgaccggacctgatcgtctctagagagattggttgcacaacgtccaacatagcccgtaggtattgctaccactgctagtatgatactccttcctagtccttgccagcaccagtgacccaaacttggtcggctgagctcagcgctcagcagctttacgtgcatctgcgccttgacttgtgcagtgggcgtcgctagcatgaatgatgtatggtgcgtcacggcctgacggttcgtcagtctgggccgtgttttgtgtccgaggaagatcgtctgtcagagatctggattgcctcgctgct

SEQ ID NO: 8897 - DNA, 2456 bp, Zea mays
cgtagctatagctggctagcttcctcctcctggctagctgctacccttcccggttctcaccgcgctgccattaaaacccccttccttgttaccacttcgaccttgagcaagcgcactcttcatgttgccgcctcgccgcagtagcagcttacatggatacgctgtttaggttggttagccttcaagcctccgaacagcagcagcagcagcaatcggcgtcctacaactcgaggagcaccacgtcgagcggctccaggtcgtcgtcgcaccagaccaacgcatcctacaactactactaccacagcaacagcagcggcggcggcggcggcgggcagtactactacggtcagcagcacccacagcagcaccagcaccagcagtactacctggagccgtaccagcaagaagaatgcggcaacacccaccacctttacatggatgaagacttctcctcctcgtcctcgtcgaggcagcatttccactcgcacggcgcggtggtgcagccgccgacgtcgtccacggccacgcccacggcgccgacgccctcgctgtccacgtcgtccacggccgctggggcggcgcacgcgctgttcgaggcggccgacctgtcgttcccgcctgacctcaacctcgacttctcatccccggcctcgtcgtccggcgggggcgcggcctcgtcggcggcggtcgggggaggtggcgggggaaggtgggcgagccagctgctgctggagtgcgcgcgcgcggtggcgggccgcgacagccagcgcgtgcagcagctgatgtggatgctcaacgagctggcctcgccgtacggggacgtcgagcagaagctggcgtcctacttcctccaggggctcttcgcgcgcctcacggcgtccggaccgcggacgctgcgcacgctcgcggcggcgtccgaccggaacacgtccttcgactccacgcggcgcacggcgctgcggttccaggagctcagcccgtggtcgtcgtttgggcacgtggccgccaacggcgccatcctggagtcgttcctggaggccgccgcggcgtcgccggagccccagaggctccacatcctcgacctcagcaacacgttctgcacgcagtggcccacgctgctggaggcgctcgccacgcggtccgccgacgacacgccgcacctgtcgatcaccacggtggtctcctccgcgccgtccgcgccgacggccgccgtgcagcgcgtgatgcgggagatcgggcagcggatggaaaagttcgcgcggctgatgggcgtgcccttcagcttccgcgcagtgcaccacgccggggaccttgcggggctcgacctcgacgcgctcgacctgcgcgacggcggcgccaccaccgcgctcgccatcaactgcgtcaactcgctgcgcggcgtggtgccgggcggtgcgcggagacgggacgcgttcgccgcgtccctccggcgtctcgatccgcgggttgttactgtcgtcgaggaggaggccgatctcgtggcttttgaccccggcgcgcccgaggaaagcggcgacacggaggcagcgttcctgaaggtgttcggcgagggcttgcggttcttctcggcttacatggactcgctggaagagagcttccccaagactagcaacgagaggctggcgctggagaggggagccggacgtgccattgtagacttggtctcgtgcccggcgtcggagtccatggagcggcgggagacggcggcttcatgggcgcgccgcatgcggtcttccggcttctctccggtggcgttcagcgaggacgtcgccgacgacgtgcggtcgttgctccgtcggtatcgggaaggctggtcgatgcgggacgccggtttagacgactcggcagccggagcaggcgtcttcctggcgtggaaggaacagcctctcgtgtgggcgagcgcgtggaggccatgatagagatccccgtcgacgcaagatgcaagctcggtggagtacgcgcgtacgtggaacatcatgaaccacaggagaagcaagggcgccatccgccatacctagccggcgcgtggatgcaatgatccatgcagtggatcgggcgcacgtgcatgtgtatggcgagctgaatggcgcaacgcatctagggttttggagcagtagtagggattgctagttcacgcacacatggttgtatgcagcaaggtgatccaggaggaggtatggtcgatggttttaggttttagacttgcatctatttcaaatttggatcatcgatcgccacaagctcttggcgtgatgattccgattttcttgcttctttgtttttttttttttgtcacatttctctgtgtttcttcatgtaattcaaggttaacgactttcttccctctggagggatttacgtgcatggttttgtcatactttctctcattcctctgtttgcatttgcattgcatggttgttgagatgtcgcttcct

SEQ ID NO: 8898 - DNA, 1329 bp, Zea mays
cgaaaaaataagaagagagagaaaaagaaaaaggagaggcccgcgactgtagtgggattgtgggaagatgcctcgggatggcgcgcaggcggcgccgccaccggagcgcggcgagatggacgaggtggtagaggcggacccggatacggaggcggaggatcaggaggagaggtgggcgaggctgctgccggagctgctctccgacgtggtgcggcgcgtcgaggcgtccggcggcgagcggtggccggcgcggaaggacgtcgtctcctgcgcctgcgtgtgccgccggtggcgggaggccgccgtctccgtcgtgcgtccgccggcggagtccggcaagatcaccttcccctcctcgctcaagcagccagggccaagggagagaccaatgcagtgctttatcaagaggaataagaacaactctacattctacctctaccttggcttcacaagttcacctgtggataaagggaagtttctcatggctgctagaagatttaggcgtggtccccataccgagtacattatatctcttgatgcagaagacttatcacaagggagcaatgcatacatggggaaactgagatctgattctgggggacaaacttcaaaatatatgatagcaagccaccatatgatggtgctaaagcatcaagtagtcgatctagtcgtcgtttcggaagcagaaggattagtccccaggtatcggctggcaattatgaagttggacaggtttcatacaaatacaacttgctcaaatccagaggccccaggagaatgtattgcactctcgaatgcccttcagcccaagagacttgggaaaactcactcaagacaaagttcaggcgccccctgggccccacaactttacgaaataaagcaccccgctggcatgagcacctgcaatgctggtgcttaaacttccatgggcgggtaacagttgcatcagtcaagaatttccagcttgtggctgctgccgaccccagtgagcctactaccaacgtggatgatgaaacggttctgctgcagtttggtaaggtcgatagcgatatgttcacaatggattaccggcaaccactctccgcgtttcaagcatttgccatcagcctcagcagctttgggaccaagctagcctgtgaatagcgatgcagtttgatgctcttcgtgtggctatatggtttgtgttggtggttgcttgcttgtttcttgttgttacgatgtgatccgttcttcgttttagttgagtatttatgtactatttgtaccacaagagatgtaataaactattgtattgtcaaacggatttgttcaaggaaattatgtgtaatg

SEQ ID NO: 8899 - DNA, 3713 bp, Zea mays
cccttttgctctccgccgcctggtgcttcgcccccctcgctctccgacgactggtgggccgccggcgccggtgccgccctacggcagttgggccttcgttggcctcttcgccggccttttcgccggtgacgagcagccactaggaaagcttctgttgctctgcatgcaacgatgaactgatgattattgttgataacagaaatgtgctgttaggttttgttcacatgtgaccatgggcagtcaaagatttctgcaacctgcattgcacctcttattcttagagaactactgcagtggttactaatatattgtgctagccactaggtaatctaacatttctgcaacgataccagcttctcttcttgtttacatggagtgcaacagagatgaggctgctagagcgaaagttcttgcggaaagaaaaatgctggacaaggattttgttggtgcaaaaaagttgattatcaaggtgcagcaactcctcaaagaagtggaagatattgacattccaaaaatgttaactgtttgtgatgttcattgtgctgctggagctaaggtaaatactgagattgattggtacggaatactgcaagtacctgtaaatgctgacgacgcactgataaagaagcagtatcgtaagcttgcccttttgctacaccctgacaagaacaaatttggaggtgcggaggcagcattcaaattagttggagaagcaaacataactctcacagacccatcaaaacgttatgtgcatgacatgaaaagaaacaccttcagaagcgttacggcaagacccaatcgtcagccaccaaaaagacctgcacctgctagatctagttctactcctgtgaatctctacaatatgcatcagcaacatcagcgtcaagcctcaaatcctacagggacgcaaacaacattttggactatttgtccagcttgtggcatgagatatcagtattacctctcgatcttgaagaaagctttgcgctgtcagaattgtttgaagccatttattgcacatgatttgaaggaccaagctattccttccggggcaaatcagcgatctgctggggtttggaaaaatgcaggcacaccacagaactctgcaggacctcaatcaaatgtcactggtcagaaaggctggtctgccacttcaggagttcatgttaataccggttctcatcatgctaatgtgaatacaaagaggaaaactgatggtaacgcaggtggactgaaaaacaaaatgaaatctgcccaggccaccaggaaaccttcaaaagcttcatcaactgctggattgaaaaggggcaggagggcggtgtttgaatctagtgaatctagcatatcagaaactgacagcgacggtgaggtagagattccaaaacatggtcctgctgaaaatagtgcagggccaggtcaacaaactcgcagatctagcaggcagaagcaagaagttaagtataatgaggatagtgatgatgataatgatgatgtggaagatgatgataacacggttgaggatgattttgttgattctcctgcgttgaaaaggctgagaaaaggtggcatgttccatggtgatcacagtactaaaacagcaaagctgaatgaagacaccgctggccataatagtgtgaatagctggggtaacataaaagataaaaagaacggtggtatgccatgtgaagagaaaacttccaatggggttgagcagatgaagagagaaacaatgcatgttggagaaaatagtgatggcaaagaagagctatttcattctgtcagcaacaatggccttggtctaaacgatgatgatgcttcagatgataacaaattcactttcccagatcctgaattttttgattttgacaaacttcgagatgcaagtcaatttagagccaaccaggtctgggctgtctatgatgatcaaggttgtatgcctagattttatgctcgaatcacaagggtaaaaatggttccaaagtttatgctacaatttgtttggttggagttcaatcctgcaaataaagcggaggaggcatggtcttacaggggtctgcctgttgcatgtggacactttacgcatggactgtcagagacaactagtgaaactggtatgttctcccggattatatcattagagagaagcaagacaaagaacttctatgaaatatatccaaggaaaggtgaagtttgggccctttttaagggatgggatattggttggagctcagatgctggcattcacaaaaaaatgaaccatcgctatgaagttgttcaagttctttctgatctcaccacgagcactagcattattgtcatgccacttgtgaagttaaaaggctatgttagcttatttgtgcagtctggagaggcagctccatatgtgatacctcaggttgacacactaaggttttctcattgtgtcccacattatttgacgagcggaactgaaaaagaaggcattccagaaggatctcttgaacttgatcctgcagcgcttccctccaacttggaagaggcttttccttctgctaacccagaatgcagttcagcaagaagccaggagtctgactccaaaaatgctggtttgtccagtggaaatcgcaaaggatccatgaatgtggggcaggggcaacataaaatagccgcgaatggaagggtttgtacaaagacaacaaaggtagagaatatcaagcataacattgatctgtctgaagttacagatgtcgttgacgatagcatttgccaaacagagtatgtatgcgccgattcagaattctacgatttttcagtaagaagatcgctccaaaggttttcacctgggcagatctgggctctctacagtgatatagataaattccccaattactatgcatttatacagaaagtagatctcaagaatgataaagtacaagttagatggcttgatgtctgtcctcaaggagaagtggagaaaagattgtcccaagatcggaccattggcattggaacctttagggttggctacatccacgacatgatgacttacactggtacagatgccttttctcatcttgttgaggccagacctactggcagaaaaggtgaatatgaaatacttcctcgtctcggtgagatatgggcagtttacaaaaattggagcgctggatggactgcgcaggattttgaaaaatgtgaatacgaactggtggagatatttggctatactgattcctccatacaagttcagcttgtgaggaaggtggatggttataagatggtatttatgtcatatagagcagggggtgtgaagacaatacggagggatgagtacccgaagttctctcaccagattccatgctttcacttgacacatgaaaaaggtggcaagcttcgaggctatttggagctcgatcccctatcactaccagaggaatttctctgctgattcgatctgagataaaccttatctacatcaaatctggagcctccggtaatgaagtttctggaacatccacaatttcgtagcactgacgttgttacggtggactcgatctgcacaactaaggcattggcttttggacttttttgctggatggctgtcctgcagctgcaattcacatgtctagtatttttttttttttgcagtaactatttgttgttagcattagctgtatctacggtttgagttctagtgtaaaaattgctacttttaacatcttgcagtgtactct

SEQ ID NO: 8900 - DNA, 2510 bp, Zea mays
agaggccgccaggcgcagatggaatgagcgaccgggctctgctccgccgctagcctgccgccgcaccgcgccgtcgatcgccgcgccatgaacggtccccgcggctaccccctttctccaccggcaccttacccccgtatggcgtgatccaatgatagcaccaagagcgcaccttcccctctccctgacggcgtcgtcctccccgcacggcggcgcgcgcacccgcaccaagaagaggaagaaaccatgtcccccaacctggacagcgccatcaagagccaggtgccggcgctgctcctgaggcgtctcttcggcgcgtcccggcgggacgaggccaagcagctccagcggaccccggcgccggtggggaggcggagggtgttcgtgcagacggagaccggctgcgtgctcggcatggacctggaccgcggggacaacgcgcacaccgtcaagcgccggctgcagctcgcgttcaacatgcccaccggcgggacctcgctcaccttcggcgatcgcgtcctggagaacgacctctccttcttacgcccggactcgccgctactgctcacccggaacagcatcaaccggagctgctccaccccgtgcctctgccccgtctccaaggacttcgagcacaaggactgcagcggactggttgagatgctcggctgctccagcagctgtgcccgggtgaagcgcctcgtggacgacgtggtgactgccatcaggagcggcgtggatccggtccccattagcagcggccttggtggctcgtactacttcaggaacgtcttgggcgacagggttgctattgtgaagccgacggacgaggagccctttgcgccaaacaatcccaaggggttcgtcgggagggcgctcggtcagccgggcctcaagagatctgtgcgagtgggagagacggggtttagggaggttgcggcgttcctgttggaccatgacaacttcgccaacgttcctgccacggctctggtgaagataacacactccattttcaacataaactgcccggtaaatggaggaaacctggcaccggctcatgaccagcaacagcaagttaacagcaagattgcttcgttccagcagttcatagcccatgacttcgacgccagcgaccatggcacgtcaagcttccctgtcgctgctgttcataggatcggcatactagatatccggattttcaacactgacaggcacgccggcaatgtgctggtgaggaagcttaacggtggcacaggccgctttggttgccagacagagctgttcccaattgatcatggcatgtgcttgccggagaacttggaggacccttacttcgagtggatccattgggctcaggcttctattccgttctctgaggaagagctcgagtacatcagaaatcttgatccaaggaaagatgtgcagatgctgcgccgggaacttccgatgatacgtgaggcctgcctacatgtactggccctgtgcacaatcttccttaaggaggctgcagctttcggactctgcttggccgagataggcgagatgatgaccagggagttcagagggatggaggaggaaccaagccagctggagcttatgtgtatggaggccaggaagagagtagcagagtgggagcccttctctgccacagctgaacatggagaagataccgatttccagttctcggtggatatgctaggagaatacagtgatgtagtgcgatcaccaaggttcaatggctcaggttccaaagtgtccagtttcagaagccctttgtctaagctcgtcgagagcgtcgacgagggcagtgatggccatgaagatcaaaacgagtctgatcgagtcttgtatgctggatggaatacatctagcgttcctagcaaagctatgggccatagtggcaatgcctcaaaaagtgcaatgaacaggagtgccgatgaacaacttccatcaagtatgtgttttgtcaggctgtcggatatgagtgcagatgagtgggatgtattcctcgaaaaattccaggagctgctgaaagagacactgcacgagagcgcaagggcagcagcaggtcaaaggatgaagcagcggctaggcacttcatgcaagttttgagcagggcaatagcgcatcagagaagaaaaaatatgcagtgctacttgtattgcttgcttatggagtgagtacaggatgaagatatcatcgtatgcggcaccttcaaccttgtgcaacgatctaggttgcagcagccatgtccagcaggtagataggaccacaagcatatgtagtgacggtgtggagaactgctacgcgtgtttattagctatatgtttacgaaggggaatgcttaataataaatgtttgtcagcctgtgtatattggcttgatgttagatactccagctttagcatgcaatttcttagtcgctgaaaattctttgtagcttgtgatgtgacctgtgagcagtgtaaacattgcacctttgatggaaaaataatgcttacctgttgttg

SEQ ID NO: 8901 - DNA, 1135 bp, Zea mays
gacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcct

SEQ ID NO: 8902 - DNA, 3403 bp, Zea mays
ctctcctctccccgccatttggctccgaaccctcacaacagtgcatcgtctctcctgtccccgccatttggttcggaactctcgcggcctcaactcctcctcgtcatcgtaacacccacgcttagagttcgtgagggtcgcccccaggggatctcgagacgtccgtttccaagagtggaccggctcgcaggcgctgctgttaccttgggtggagctcggacctgcggatcagttggattctcaagggagacggtggtttctgatttcctttctctaagcataccaaatcctttgtctcgagtcgggagcaactggttttgggcgtcgcggagcacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcgggctaataatgggcagtgcttgccaagctggcacagacgggccttcccgcaaggatgtgttagggatagggaatgccgccttagagaatggccaccatcaggctgaagctgacgcagatgaatggagggaaaaggaagaggacttggccaacaacgggcacagtgcgccaccgccaggcatgcagcaggtggatgagcataaggaggaacaaagacaaagcattcactgggagaggttcctacctgtgaagacactgagagtcttgctggtggagaatgatgactctactcgtcaggtggtcagtgccctgctccgtaagtgctgctatgaagttattcctgctgaaaatggtttgcatgcatggcgatatcttgaagatctgcagaacaacatcgaccttgtattgactgaggttttcatgccttgtctatctggtatcggtctgcttagcaaaatcacaagtcacaaaatttgcaaagacattcctgtgattatgatgtctacgaatgattctatgagtatggtgtttaagtgtttgtcgaagggagcagttgatttcttggtaaaaccactacgtaagaatgagcttaagaacctttggcagcatgtttggaggcgatgccacagttccagtggaagtgaaagtggcatccagacacagaagtgtgccaaactaaatactggcgacgagtatgagaacggcagtgacagcaatcatgatgatgaagaaaatgatgacggcgacgatgacgacttcagtgttggactcaatgctagggatggaagtgacaatggcagtggtactcaaagctcatggacaaagcgtgctgtggagattgacagcccacaacctatatctcccgatcaactagttgatccacctgatagtacatgtgcacaagtaattcaccctagatcagagatatgcagtaacaagtggttaccgacagcaaacaaaaggaatgtcaagaaacagaaggagaataaagatgaatctatgggaagatacttaggaataggtgctcctaggaactcaagtgcagaatatcaatcatctctcaatgatgtatctgttaatccaatagaaaaaggacatgagaatcacatgtccaaatgcaaatctaaaaaggaaacaatggcagaagatgattgtacaaacatgcctagtgcaacaaatgctgaaactgctgatttgattagctcaatagccagaaacacagaaggccaacaagcagtacaagccgttgacgcaccagatggcccttccaaaatggctaatggaaatgataagaatcatgattctcatatcgaagtgacaccccatgagttgggtttgaagagatcgagaacaaatggagctacagcggaaatccatgatgagcgaaatattctgaaaagatcagatcagtcagccttcaccaggtaccatacatctgtggcttccaatcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcagcatttcatactatacagaatcaaacgtcaccagctaatctgattggggaagacaaagctgatgaaggaatttccaatacagtgaaaatgagccacccaacagaggttccacaaggctgcgtccagcatcatcatcatgtgcattattacctccatgttatgacacagaaacagccatcaacagaccgtggatcatcagatgttcactgtggttcgtcaaatgtgtttgatcctcctgttgaaggacatgctgcaaactacagtgtgaatgggggtgtctcagttggtcataatgggtgcaatgggcagaatggaagtagcgctgtccccaatattgcaagaccaaacatagagagtattaatggtaccatgagccaaaatattgccggaggtggcattgtaagtgggagtgggagtggcaatgacatgtatcagaatcggttcctgcaacgagaagctgcattgaacaaattcagactgaagcggaaagatcggaactttggtaaaaaggtagcctgttttcagttacatgcctgttgtagctatgacttgaaatcagtaatagttatttgagggttgaagggccttccacttaatatataaaagtaagggtagggattcaaatggtttgcacaattataatcagaaaaaagatagaagtgattattaataatctctacctttggaggatataaaaatgcttatgctacttccagctatgccttttgtctttttttagaaaaacttccagttatgacttaattgttaatattgacaataccagtgtaggaatactgaaattagtcttgaaagtaagacattagttgctgctgtttgcgtgatggcccctagcttgaggatactttgccgctactcttgcggatgctttgccgctccatgtcatctctagcggacgctctgctgtcgtgctgctggatgtttgtctcgtctcctctcaggggatgctctgccactgcagtgtcttcgtctttattggcaacctggagttgatgtgcttttccttctgcaggttcagtcggttagattttaggtggagagtccttcttactgcattttctttctctggttctttgggtcggtttaggttgctaaccacttctgtgcttttgtaatatgggcgacggggtctctcagtagctttgtcataaaacaattctacttccccttaatatagtacatgtgactctgacatgttatcgaacaaaaa

SEQ ID NO: 8903 - DNA, 902 bp, Zea mays
aatggcggccaccgcgatggaccatgacggcggcgacgacgtggtcacaccaggggagcttctcggaaactcattaaccctcgcggccggacgtggcgcctacgccgacggtcgctctgtgcgcgcgtcggtcaccgggcgccgccgcatcgtgccgcccgcacctgcctccgacgaccagagatccacggtggaggtggtggggcacaaggcccatggagctgtgccgcagccgggaagcgtcgtcatcgcccgagtaacaaaggttatggctagaatggcctctgcagatatcatgtgtgttgactcaaaggctatcagagaaaagttcactggcatgataaggcagcaagatgttcgtgcaactgaaattgacaaggtggatatgtaccaatcatatcgtcctggggacattgttaaagctatggttctttctcttggtgatgcaagggcatattacctttccactgcgaaaaatgaacttggagtcgtttcagcacaaagcatagctggtggtacattggttccaatcagttggactgagatgcaatgtgatttgaccggtcaaattgagcaaaggaaagttgcaaaggtggaatagatgtgctgtggccctcctgataaatggtggtggcggtatacaaattgtggaccagtgacaccaggtccttgggcggactacccaattctgcgacgtccaacttcattacagctgcattgagcatgggtttttaaaaccctggctgaatttaactagacatgaatcgtagccatgggtcctgtaacccaaccttgggatctgaatcatagccatgggttctgtaacccagtaaccttgcccttgtgatttgttactctgtgagctaatgacattgcagttttccaaaaaaaaaaaaaaaaaa

SEQ ID NO: 8904 - DNA, 1683 bp, Zea mays
aaggagaagggggagctgtaatcctacctaagaagcggcgatggggcggtcaggaggcggcgacggggacggcgacggcgaccggctcctcctcggcaagcccttggagtcgtcgtcgtcgtgcagctcgtccgacgagagcctggtcaagagaaccggcacggtatggacggcgatggcgcacatcatcacggcggtgatcgggtccggcgtgctgtccctggcgtggagcgtggcgcagctggggtgggtgggcgggcctgcggcgatggtgttcttcgccggcgtcaccgcggtgcagtccaccctcatcgccgactgctacatctgccaccacccggagcgaggaggcgtcgtcaggaaccgctcctacgtcgacgccgtgcgcatctacctgggcgacaagagccatttgttttgcggcttcttcctcaacctgagcttgtttggcaccggtgtggtgtacacgctcacttccgccactagcatgagggcgatccggaaggccaattgctaccacagggaaggccacgacgcgccgtgctcggtgggaggagacggctactacatgctgctcttcggcctcgcgcaggtgctgctgtcgcagatacccaacttccacgagatggcggggctctccatcttcgccgccgtcatgtcctgcttctacgccttcgtcggcgtcggcctcggcgtcgccaaagtcatcgcaaacggggtgatcatgggcggcatcggaggcatcccgctggtgtccacgacgcagaaggtgtggcgagtctcgcaggccctcggggacatcttgttcgcctaccctttctcgttggtgctgctggaaatagaggacacgctgaggtcgccgccgccggagagcgagacgatgaaaaaggcgacgagagcgagcatcgctatcaccaccctcttctacctctgctgcgggtgctttggctacgcgtcgttcggcgacggcaccccgggcaacctcctcaccggcttcggcttctacgagccctactggctcatcgacctcgccaacctcgccatcgttctccacctcctcggcggctaccaggtgtacacgcagccggtgttcgcgttcgcggaccgcaagttcggcggcggggccacggtcgtcgaggcgccgctgctgccggtgccgggcgcgcgccgcgtgaacgcgaacgtgttcaggctgtgcttccgcacggcgtacgtggcggcgaccacggcgctggccgtctggttcccctacttcaaccagatcatcgggctgctcggctccttcaccttctggccgctcgccgtctacttccccgtcgagatgtacctcacgaggaacaaggtggcgccgtggaccaaccagtggctcgccatccatgcgttcagcctcgtctgcctgctcatcagcgcgttcgcctccgtcggctctgcggttggcgtgttcgggtcggagacgagctgattcaaactctgcaaatgcaattgccggccacttttcggacatgcatgttctgtgcatatactgcgcttgtacatttagcgttatacctagtactggaacggtcaggccgggccccgagcctcgtgcttaggctcaaacgggtctgggcccagaaggtccaaatttttttggatcataccgtgtcagcctaaagagtagaaatagtggtttagccaggctct

SEQ ID NO: 8905 - DNA, 1420 bp, Zea mays
ccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctgaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatcggcagtcatcgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctaaatggacggtcattgttgaactaccctttttcaggaggggcaactttcttcatactgctttcgtgctccctggcggtgttctgcaacatgagccaatacctctgcatcgggcggttctcagcgacctcgttccaggtcctggggcacatgaagaccgtgtgcgtgctgatcctgggctggatcctgtttgactcggccctcaccatgaagaacatcctcgggatgctgctcgcggtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttctgtaactgtgcgcgcgcggtcggtcgatgcaaagttgcttgttcgtcggttctcagctatcgacactacactgttaattttgttggccccttgttggggggagtccgctcgtaggtgaaggtgatcccccctcccccgggttcgacgtagatgaaacacacgcgggcagattgttaggatttttcaggcggggaggtggcgacatgctgttatagatggtgacaagactttatataatggaaatgcaggtgtttttg

SEQ ID NO: 8906 - DNA, 1484 bp, Zea mays
ctcgacgaaggaggaacgaacggacaggttgttgcacagaagcgacatggctttcgcgcccaaaacgtcctcctcctcctcgctctcctcggcgttgcaggcagctcagtcgccgccgctgctcctgaggcggatgtcgtcgaccgcaacaccgagacggaggtacgacgcggccgtcgtcgtcactaccaccaccactgctagagctgctgcggctgctgtcacggttcccgccgccccgccgcaggcgccggcgccggcgccggtgccgccaaagcaagcggcggcacccgccgagaggaggagccgtccggtgtcggacaccatggcggcgctcatggccaagggcaagacggcgttcatcccgtacataaccgccggcgaccccgacctagcgacgacggccgaggcgctgcggctgctggacggctgtggcgccgacgtcatcgagctgggcgtgccctgctcggacccctacatcgacgggcccatcatccaggcgtcggtggcgcgggctctggccagcggcaccaccatggacgccgtgctggagatgctgagggaggtgacgccggagctgtcgtgccccgtggtgctcctctcctactacaagcccatcatgtctcgcagcttggccgagatgaaagaggcgggggtccacggtcttatagtgcctgatctcccgtacgtggccgcgcactcgctgtggagtgaagccaagaacaacaacctggagctggtgctgctgacaacaccagccataccagaagacaggatgaaggagatcaccaaggcttcagaaggcttcgtctacctggtgagcgtgaacggagtgacaggtcctcgcgcaaacgtgaacccacgagtggagtcactcatccaggaggttaagaaggtgactaacaagcccgttgctgttggcttcggcatatccaagcccgagcacgtgaagcagattgcgcagtggggcgctgacggggtgatcatcggcagcgccatggtgaggcagctgggcgaagcggcttctcccaagcaaggcctgaggaggctggaggagtatgccaggggcatgaagaacgcgctgccatgagtccatgacaaagtaaaacgtacagagacacttgataatatctatctatcatctcggagaagacgacgaccgaccgaccaataaaaataagccaagtggaagtgaagcttatagctgtatatacaccgtacgtcgtcgtcgtcgttccggatcgatctcggccggctagctagcagaacgtgtacgtagtatgtaatgcacggagtgtggagctactagctagctggccgttcattcgattataattcttcgctctgctgtggtagcagatgtacctagtcgatcttgtacgacgaagaagctggctagctagccgtctcgatcgtatatgtactgattaatctgcagattgaataaaaactacagtacgcatatgatgcgtacgtacgtgtgt

SEQ ID NO: 8907 - DNA, 940 bp, Zea mays
cccagttgcccccaaaccccagccaccagctaccaatggcggccaccgcgatggaccatgacggcggcgacgacgtggtcacaccaggggagcttctcggaaactcattaaccctcgcggccggacgtggcgcctacgccgacggtcgctctgtgcgcgcgtcggtcaccgggcgccgccgcatcgtgccgcccgcacctgcctccgacgaccagagatccacggtggaggtggtggggcacaaggcccatggagctgtgccgcagccgggaagcgtcgtcatcgcccgagtaacaaaggttatggctagaatggcctctgcagatatcatgtgtgttgactcaaaggctatcagagaaaagttcactggcatgataaggcagcaagatgttcgtgcaactgaaattgacaaggtggatatgtaccaatcatatcgtcctggggacattgttaaagctatggttctttctcttggtgatgcaagggcatattacctttccactgcgaaaaatgaacttggagtcgtttcagcacaaagcatagctggtggtacattggttccaatcagttggactgagatgcaatgtgatttgaccggtcaaattgagcaaaggaaagttgcaaaggtggaatagatgtgctgtggccctcctgataaatggtaaacatgtggtggcggtatacaaattgtggaccagtgacaccaggtccttgggcggactacccaattctgcgacgtccaacttcattacagctgcattgagcatgggtttttaaaaccctggctgaatttaactagacatgaatcgtagccatgggtcctgtaacccaaccttgggatctgaatcatagccatgggttctgtaacccagtaaccttgcccttgtgatttgttactctgtgagctaatgacattgcagttttccaccttgtgatttct

SEQ ID NO: 8908 - DNA, 1332 bp, Zea mays
ctccattattcccagcgggcgcgctcgctctctctttctccctcccctcctcgtggcgacgattgggggcagtcgctgccgccgtacgccaggtgcccagatcttcttcatgcccttctccagcgacgagtatcagaagtgccttgcacgggtaccattcttgttccatccgacgcttcagttggtttgccgctcttggcgagcatcagtttgcagtggcgaacttctcaaaattcgtaaccagattggtacgacagaagagctcttgtgtgtgttggcgtttgaaccagaaaacatgtggcaactttatgatcccctacgagacaagtggataactcttcctgtcatgccatctcagattaggaacatagcccgctttggcgtggcctcagttgctggcaagctctatgtaattggtggtggcagtgatcgagttgatccgcttactggagatcacgacaggatctttgcaagcaatgaggtttggtcttatgatccgctgcaccgtgtgtggtcccagagggctcctatgcttgtggctcgagcgatgtttgcttgttgtgcactggatgggaaaataatcgttgcaggaggcttcactaactgccgcaaatcgatatcaaaggctgagatctatgaccctgaagctggcatatgggagcctcttcctgaccttcgtctggctcatagctctgcatgtactggacttgtcatcaagggtaagatgcatgtattgcataaaggtctatcgacagttcagattctggaagatggtggcagtcattgggctgttgaggatttctcttggttgcaaggcccgatggcgatggtcggtggagagctgtatgtgctgagtaacagctgtattatgaagcaacgtggtgagaacttccctgataagatggtatcgtgtgcatctgagttccagagcaggatcggtttcgggatgattggtgtgggtgacaacatatatttggttggaggagtgattggacctgggccgagaaaccaatgcatcaagctgctctctgatgttgatatcttgaacgtcacaagtgagagaccaacctggagaccagggtcgccgatgacgcattgccgagggagcatctgtggctgcgctttgttgaggatttagcgtcttcccagtgtgatagtgtgagtattccaccattgctgaactgatcggtgacgtcctaagttttattttattttcaaaagggttgttatttacgctttccttttggatcctttgtagcattgagggcatgactcaatgttggattgccaatgagatatatactatattgaccatgaacagtgttccagaac

SEQ ID NO: 8909 - DNA, 1340 bp, Zea mays
gccctgtggtgtactggtgtgtcacgcccctcgtcactcaccccgtcagccgcaaccccatcttctattcttcccgacggcgctcctggcagcaggaacaagatgtccaatagggccacacattggtgttatgcctgtcggcggccaattcgtctccgtgggcaggatatcgtatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgttcgatattcgtggtagacaaggaacaggtactgaatatggaaggagaccaactgctgttcctacattggtatttggcggcatcccttctcctggagttgatagcggtgatgttaatgttgtcctcaggggaggccgcagagttggcgctgcccaaccaaatttcagtagtttagttgttggtcccagtctggaagccctttttgagcagctacttctccagaacaaccgtcaaggcccagcacctgctccacagtcagctattgactccatgcctgtggtaaagataaaccgcaggcatcttgacgacgatccacagtgcgcagtttgcaaagacaaattcgaggttggagcagaggcacgggagatgccatgcaagcacctgtaccatactgactgcatcatcccctggctggttcagcacaattcttgccctgtttgccgccatccactgccatcacagagatcaggcagtaccagtagcgcccggccttcagcttactacaacgaagccgctgatcctcctggggtcaccagagcagatcttgaacctgctccaagagacggtggcagggaaagccaggaaaggcgccgctccttctcgtttctgtggccgtttggcccgtcgagttccagatccagttcttaccagtacgaacagaatgttgatgagcctgcagtatacgatccaaaccagatagcatattctgagtggcactatgaccactgactgaaaccctgcagcaagtgcaagctatctgcaattcgtgccttcaaccctcagctttggagaggcattcatcagctgtaatggctgcttgccgtataaaaaaaggatggttcttgcctttatattgtgttcagtgcagccttgctccgtatgtccgtcgtatatataatcccttgcgtgtagtaagcggtgaactgaatgcatccagaatatcatgtcatgataaacttgaatatagtttcatggtttatttcagactg

SEQ ID NO: 8910 - DNA, 898 bp, Zea mays
aaggatggagaccatgtcggctctcgcgaggacggcgccgccccttgctgggaccattcgccggccgtcctgcgcgctgcggccgacggcgtccctctccttcgccgccgcttcaacgacgccccgcggccggctcgggctggggctgagcacggcgccggcggggagcgggagggcggccagggctcgcgccgtcccgcagcgcatcgtcgcctcctcggaggttgagcgaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggccctgttgtctgcatgctacaatcttgttattctattctgtaaaggcctgggagggtgctggtgttgttgcatcagctcgcaaattaataggagctactaacccccttcaagctgaaccagggactataaggggtgatcttgcagttcaaactggaaggaacgttgtccatggaagtgatagtcctgataatggcaagcgtgaaattgaactgtggttcaaagaaggcgagctctgccaaaatgggaatcagttcaagcaccgtggcttatagaataactcttgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagct

SEQ ID NO: 8911 - DNA, 2017 bp, Zea mays
accccaagcgcgcacccatcttctggcctttccagccgccaagccttctagaagcttcaagagctcgattcgatcggaaccctcgccatggccgacgaggcgaaggcgaagggtaacgcggcgttctcggccggccgcttcgaggaggcggcgcggcacttcacggacgccatcgcgcttgccccagacaaccacgtcctctactccaaccggtcggcggcgctcgcctcgctccaccgctactccgatgctctcgccgacgcgcagaagaccgtcgacctcaagcccgactgggccaagggctactcccgcctcggcgcggcgcacctcggcctcggcgacgcggccagcgccgtcgccgcctacgagaagggcctcgagctcgaccccagcaacgagggcctcaaagcggggctccaggacgccaagaaagccgccgccgcccctccgcgccgcgggtcgtccggccccgacgccatcggccagatgttccagggccccgagctgtggagcaagatcgcgtccgacccctccacgcgcgcctaccttaacgagcccgattttatgcatatgatgcgcgaagtgcagaggaaccccagcagcatcagtatgtatctctccgatccccgcatgatgcaggtgctcagcctcatgcttaatgtcaagatccagagacccgaggcctccgagccgtcgcagtctaccccgccgccgccgaagcagcagcagcagcagcagacgccgccttctgagacgaaggctagggatgtggagcccgagcccgaggcagagccgatggatttgactgatgaggaaaaggaccgcaagcagacgaaagctgctgctcagaaagagaaggagttaggtaacgcagcttacaagaagaaggacttcgaggtggcaatccagcattacaccaaagccttggaacttgacgacgaggatatttcctatctgactaaccgagcagcagtctacattgagatgggaaagtacgatgaatgcatcaaggactgtgataaggctgtggagaggggaagagaacttcgtgctgatttcaagatgatttcaagggcactgacaagaaaaggaacagctctggtcaaacttgctaagacctctaaggattttgatattgctatcgagaccttccagaaggctctgactgagcatcggaacccagacactcttaaaaagttaaatgaggctgagaaagcaaagaaagagttagagcaacaagagtattatgatccaaaattggcagatgaggagagagagaaaggcaatgagttcttcaaggagcaaaaatacccagaagcaataaaacactacacagaggctctcaagagaaacccgaaggatcctagggtttatagcaatagggccgcctgctacaccaagttaggagccatgcctgaaggtcttaaagacgcagaaaagtgtcttgaacttgaccccaccttcaccaaagggtatacgaggaaaggtgcaattcagttcttcatgaaagaatatgacaaggccgtggaaacctaccaggctggcttgaagcatgacccgaacaaccaggaactgcttgatggtgttaagaggtgtgttgaacagatcaacaaggccaacagaggtgaaataagccaggacgaattgcaagaaagacagaacaaagctatgcaagacccagagatccagaacattcttaccgaccctatcatgcgacaggttctaatagatttccaggagaacccaagtgcggcccaggagcacctgaagaaccccggggttatgcagaagattcagaagcttgtaagtgctgggatagttcagatgagatgatcgagcgatgcgatgattggctttgttcgttcacgtgcaccctggtcatacatatgttttaacaagcagcagcggcataagaatgaacctgttcgggggctaatcttattccttttggattgtaagtgcattgacattggataattcatgtttgtggcactgagtttcgagtaaaaaaaaaaaa

SEQ ID NO: 8912 - DNA, 1819 bp, Zea mays
ggcagctggaactgaaggtggcgggagccgagtgatccggcggtgagctgagcggggcgggatggcggcggagcaggggcggtcgctggcggagacgcccacctggtccgtggcaaccgtcaccacgctcatggtcgctgcctgcttcctcgtcgagcgctccctctcgcgcttcgccaagtggctgcgcaagaccaagcggaaggccatgctcgccgcgctcgagaagatccgcgaagagctgatgctgctcggagtcatctcgctgctgctcagccagacggcgcgcttcatatcggagatctgcgtgccgtcctcgctcttcaccagccgcttctacatctgctccgagagcgactaccaggacctgctgcgcaacacggacgccaaccagacggcgctcgacaagaacatgttcggtggccaacggctgcacgtctgtggcgagggccatgaaccttttgtttcgtacgagggccttgagcagctgcaccggtttctcttcatccttggtatcactcatgtgttgtacagttttgtaacagtggttctgtccatgatcaagatctatagctggaggaagtgggaaaccttagcaggtccaattgctgctgaggaattgaaagctaggagaaccaaggtgatgagaaggcagtcaacctttgtttttaacaatgcttctcatccatggagcaaaaataaaatacttatttggatgctttgctttttgcgtcaattcaagggctccataataaggtcagactatttggcactgaggttgggctttgtcacatatcacaagctaccacattcatatgacttccataaatacatggtacggagcatggaagatgattacaatgggactattggtatcagttggccactttgggcatatgcgattgtctgcatattaatcaatgttcatggtatcaatatatatttctggttgtcctttgttcctgttattctggtgcttctagtgggtactgaacttcagcacgtcattgctcagttggctttggaagtcgctgaggcaacagcgccttatgttggctcacaacttaaactgcgtgatgatctattttggtttggaaagcctcgggtactctggtggcttatacagttcatttcatttcagaatgcttttgagctggcaacattcttatggtctctgtgggaactcagtgcacaaacatgtttcatgaagcactactacatggttgccattcggttgatttctgggctcctagttcagttttggtgcagctacagcacactgccgctgaatgtgattatttctcagatgggttccaagttcaagaaatcactggtctcggagaacgtgagggagtcgctgcacagctggtgcaagagggttaaggacaggagccgacacaatccgctcttctcgcggaacgggaccctcacgaccagatccgtgtgctccctagacaccacctacgagacggatcacgagacgaacacggtgtgcacgctgtcgaggacggcgtcggcgacgtcgctggacgaccagttgaccgtggtcaccgtcgatgacgagccgtcctgcattgagaaggatgtctgacgcagttgctgattcgccaaaactacatactgcaccgacctgtgtgttaggaggtactctaggactgaaatgaatgtatatgtgcagtggttgcccctatcgtggcagtgaccatgtgtatatatagaactaaaaaaactataatgtctcttagctgagagtgagaggctgtacatggaaatacttgaggcagcttggaccaaatacaaaactgcatcttttcgagat

SEQ ID NO: 8913 - DNA, 642 bp, Zea mays
caccgccgccgcctttcgtaccgcggcccctaaacccctttcctcgttcccctccgtctctcagttaggcacaatgatgctagctaataagcttggtggtctgctcaagaatgctacgagttcaaatatgtctgtctaccaagcaatcagatgcatgtcatcatccaagctttttgttggagggctttcttatggaaccgatgatcacagtctcagagacgagtttgccaaatatggacaagttattgaagctaagattatccttgatcgtgagtctgggaggtccagaggttttggctttataacttacacgtcttctgaggaggcttcggctgccatcactgccatggatggaaagactctggatggacggaacatacgggttaatcatgctaacgagaggacaggtggcttccgcagcagcggtggttatggcggtgggctgtttaagatggcccagggcttcctcaagtagatatattgtctggccaacgtacgtgtactcttgtagtatctgttacgtaattagcttcaaaataatgttcccctcgcctttatttgctgttcaagtccctgtaataaccgagaacgttaattgtagcagtgtgttttttatatgattaaataagtactatgttgtat

SEQ ID NO: 8914 - DNA, 1447 bp, Zea mays
cgaaatccaactcaccggtgtccttggcttcgttcttttcaccggtctgctaccgactcacgcccggcgaactctagccgcggccacgggtcatcacacatggtctcctggcggcgcagcgcgtcctggctgtcgtcggcgtcgcgctcctcgctcggcgccgccgtcggcggggaggccaaggtcacgccggaggcggatccggcggcgcagcacgacgaggccgacgaggagcgctggtcgcgcctgctgccggagctgctcacggagatcatgcggcgcgtcgacgccggcgccgagcgctggccgccgcgccgggacgtcgtggtctgcgcctgcgtgtgccgccggtggcgcgacgccgcggtctcggtcgtccgcccgccgctcgagtgcggcaggatcaccttcccgtcgtcgctcaagcagcctggaccaagggatgcgccgatgcactgttttatccggagggacaaaaaaatttcaaccttttctctctatctcagcttaacgcaggccctaacggataaagggaagttccttttggctgctcgaaggttcagacaaggagcacatacagaatatatcatctcttatgactatgatgatctgcacccaagaagcagttcatatgttggaaagttgagatctgacttcttggggacaaagttcatcatctatgatacccaggcgccatatgacggtgccaaaccttctaggacccgatccactcgccgctttgcaagcaagcagataagcccacaggtttcaggcggcaatttcgaagttggacaagtgacctacaggttcaacttcatgaaatcaagagggccgagacggatgcagtgcaatatccagtgccctgtaggccagggcagcgcttcggatccatccaaggagaaaacaccctcgccgagttccttggacctgaagaacaaggctccaagatggcacgaccatcttcagtgttggtgcttaaatttccacggccgggtgaccgtcgcctccgtgaagaacttccagctcgtcgccacagctggctccggtggtccatggggcgtcggagacgaggagacggtgatcctgcagttcgggaagatcgaggacgatgcgtttacgatggactaccggcagcctctgtctgccttccaggcgttcgccatctgcctcaccagctttggcacgaagctggcctgtgaataaatggttgccggtttaccaactatgttggggatcagattgtagggggtagtctgaactagttgccctgagcacctcagatgggagaaaactggcgataagaaacagggcggacgttgtccctataagctttgactccttgtaatcgcctaaatgattgatttatatatatatgatgtgcgcctatgttgttgaagagatgacgatgacttatcgttgtaaatggcactccacttcgtttggtgac

SEQ ID NO: 8915 - DNA, 1897 bp, Zea mays
ccgggtgcactgatctgggggccgcgtgtccccggtggtggggcgaggcggcgccggcttccaggaatgggcaacttgtagcgtcggtttcttttgcatatgcactttctattgttgttgtcatttcaaaggaggccatagtctcctggattttgtatgccttgttatctggaattggtgaccatagatgtcattccgtagcatagtccgtgatgttagggatggctttggcagcttgtcgaggagaagctttgaggtgaccctcgcaagcatttatggccttactgggcatcacaaagggaagacccagagctcatcacatgttctcgacgactcaccttccataattcgtgaaagtcgatgggcgaatctacctcctgaactcatccgtgatatcatacggagactggaggctgatgagagcacctggccagcgcggaagcacgtcgtttgcttcgcagctgtttgtaggacatggagagaaatgtgtaaagagattgtgttgagcccagagttctgtggcaagctcaccttccctgtgtctctaaaacagcctggtcctcgagatggaaatacaatggtccagtgttttataaagaggaataagtcaaaatccacttaccatctctacctgtgccttagcaatgttgttacttcagaaagtgggaaattcctcttatcagctaaacgacaccgcaaaaccacatgcaccgagtacactatatcaatggattctggcaacatctcaagatcaaaaagaacctacattggaaaaataaggtctaacttcctaggcacaagatttttaatttatgatacacaagccccctataatggggctgtagttcctcctgccggaaggaccagcaggaggttcaactccacaaaagtctctccaaagctgccttcagtcagttacaacatcgcacaggtatcgtatgagctaaatgtccttggcacaagaggtcctaggcggatgcgttgcatcatgcactccatacctgcatcatcagtggagccaggtggcacagtgcctggacagccagagcagattgtacctcgagccctggaggattcattccgcagcacggcttccttctcgcagtcgttccgtagcactgcctcattctccaagtccatcatggactcgtccatggatttcaatagcgctcgcttctctgacatagctggcagcagcgctcgcttcacgggcgttcctggtagcagtgctcgctttgcgggcgttcctggcagcagcgctcgcttctcgggcattgctggcgccagattggacaacgacgaggagagtgaaaccaaggagaggccactggtgcttcgtaataagccgcctaggtggcacgaacagctgcagtgttggtgcctcaacttccggggccgtgtgacaattgcctcggtgaagaacttccagctgatcgccgcggctaccccgccacccgcaggtgcgccaaccccctcgcagcctgctccgtcagatcctgacaaggtgattctccagtttggcaaagtggcaagggatatgttcacgatggactatcgctaccctctctcggctttccaggcctttgccatttgtctgagtagctttgatacaaagttagcctgtgaataaatggagaagaacaaaggtaaaggagaacagcaggttgcttgcattaggccatcagtgtacctctttccatctggctctcgtgttgccttggttgtattttgtgcttaatgtagccatgaagttggtggccatatatggacgcatgtgttgttgttggccctctcccttagaaatgattaaaagttgcatttggaccacatgttacccgatctgtaatatacttgcagtggcattgcatgccgcgtgataacaaagttcccgttcgtg

SEQ ID NO: 8916 - DNA, 1480 bp, Zea mays
ctcctctctgcttctcggcctagctagctagctcggtgcctcggccaaccgggcgtcgcgcgctggccggccggcctgccaggcgagaactagctagcagcgcaagcaacaatggcagattcaggggaggggcgtcgggtgtgcggcatgccggagaaggcgcagctgcacgtggcgatgctgctgctgcagttcggctacgcgggcttccacgtggtgtcgcggctggcgctcaacatgggcatcagcaagctcgtcttccccgtctaccgcaacatcatcgcgctctgcctgctcgtgcccttcgcctactttctcgagaagaaggacaggccgcagctgaccctcaacttcgtcgtccagttcttccttctcgcgctctgcggcatcacggcgaaccaagggttctacctgctgggcctggacaacacgtcgccgacgttcgcgtccgccatccagaactcggtcccggccatcaccttcgccatggccgcggcgctgcggatcgagaaggtccggctggaccgccgcgacggcgtggccaaggtggcgggcacgctggcgtgcgtggcgggcgcgtccgtcatcacgctctacaagggccccaccatcttcggtcccagcggcagcggcggcggcggcggcctcgagctggcggcggtgggcggcgacaagaactggacgctggggtgcgtgtacctgatcgggcactgcctgtcgtggtcgggctggctggtgctgcaggcccccgtgctgaagaagtacccggcgcggctgtccgtcacctcctacacctgcttcttcggcgtcatccagttcctcgtcatcgccgccttcatggagagggacgcggaggcctggaagttccactccggatccgagctcttcaccatcctatacgccgggttcatcgcgtccggggtggcgttcgcggtgcagatctggtgcatcgaccgtggggggccggtgttcgtggcggtgtaccagccggtgcagacgctggtggtggccatcatggcgtcgctcaccctgggcgagaagttctacctggggggcatcatcggcgccgtgctcatcgtcgccggcctctacctcgtgctctggggcaagagcgaggagagggcgcgcgtcgccagggacgccgtctccggcggcgaccgcgaggggctccttgtcgcggcagccgccggaggtggtggcggcggcatcatcaggagcgccggcaataaggtggcgtcggccgcgacgcagcctctcctgctgccgtcctccacctccactgacaacgtctgaccgatccatggatggatgaatcgtcatccatgcttgcttggtgcgtggagatctgaggcagcatgcagaattaccagttattagtcatttctttgaggttttcccctgttgattttcacgcatgtatgtatgctgctacctacgtgtacgtacgtatatgcatgcatcactatggttgttttacgcc

SEQ ID NO: 8917 - DNA, 1383 bp, Zea mays
cctgacaccatactatacctccccctccccggccctgtcctactagccgtcagaggtttgccgcctcctcgctcctcgtcttcatcactctctctctctctctctctctcttccttcgtcctcgacctgtggccacctgtggcgtcacgctttataagagcacgcggccggcaaccatctcccttgccacccacaagtagagaagaatcttttgttgctgacgcctgagacgctggcactgccgccgcgccgtctggagagaaagagcagagggacactgaagcagaggagccgaggggtagcgacgagagacgagcgagagcggacgacggagatggaagcaggaggagcaggagcggagggggtgatgagggtgctgctggtggacgactcccccgtcgaccgccgcgtggcgcagctgctcctcagcagcaactcctgcgccggctcattccacgtcatcgccgtggacagcgccaagaaggcgatggagttcctcggcctcaaggacggcggcaaggagcaggccatcgacatggtgctcacggactactgcatgccagagatgaccggatacgacctgctcaaggccatcaaggcactgaacccgctgaagccgatccctgtcatcgtcatgtcgtcagaagacgagccccagaggatcagccgatgcctgaacgccggcgccgaggacttcatcgtgaagcccctgcagagcaaggacgtgcagcgcctccggaactgctccacggtcgggaggcccagcaacaagggcggcgccacgttgccgtgcgaggagaacgccgtggccaagtggagtaacaacaagctgccgccctccgccggcgccggcgccggcgccagcgccacgtcgccgtcgggacggcgggcgaacctcgccggagtcgccatgcgccaggtgctgcactcgtcgagcgtggagatctcgcagtacctgccgctcctgctcaagctcgtcgtgctggcgtacgccgcgctgtgcctgggcgagctcctgcacagatggtcgtcgggcggcagctgctcgctctccccgtggtgcgcctgatcaggaaggagcaagcagcgcaaaaagccagcaacggtgcaagagccccccctgggcaccgacgacaggagactgctgctgcaccaagcattatttcaggctccaatagccctagtcttttaatttaggtagagattgtctctgctctgagatcctaaccggggtttcgaccgatgatgagtccccccgtggcttttgttcgttgatttgaggggccgtagacgtaggaaggaggaggaactgaacgaaccccttgtatcctctgctctgtatagaatgaatgaatgaatgaatgaatcagaatgcaacgcgtc

SEQ ID NO: 8918 - DNA, 2612 bp, Zea mays
cagaaattggatcaattcaagtagaggtctaggaggagatatgaggtactacttgcgtcaggtccagcgtttggttggagatatggaaggaggagctctcttgtttatagacgacctcaactccaagtgacaaagcgaacagctgttgaacgtttcccttctatttctgtttctttttgccggatttggagatggagatgaattcctctggcgaggaaactgtggtaaaggtaagaaagccgtacacaataacgaagcagcgggagcggtggacagaggctgaacacaaacggttccttgaagccttgaaactttatggcagagcatggcagcgcatagaagagcatgttgggacaaagacagccgtgcagatcagaagtcacgctcaaaagttcttcactaagttggaaaaggaagctatgaacaatggtacttctccggggcaagcccatgacattgacatacctccaccacggcctaaaagaaagccaaacagtccatatcctcgaaaaagttgtctcagctccgagacacaaaccaaagaacttccaaatgacaagtcaacaaaaccaaatatgcccttgagcaatgggcatgtaaaaatggtaggcgatgcatctcttcagaattttcaaaggaaggagttgtctgaaaaaggaagtcgctcggaagttcttaatctcttccgtgatgccccatctgcatcattttcttcagttaacaaaagctcttcaaatcatggggcacccaggaggaccgaggcaagtaaaacagaaagccgagatatgtccatcatggaaaataattcttttaaccccaacacccaagaggatgtaaaggtgatcagtgatcaggaaatggaaaggcttaatggtatccagatcagatctaaatgtgaacattctcatgaggggtatttggacatctcaacgcaacaaatgaagctaatgccaaagtctgtggagacaacatatgtggatgaacaaactgcaagagcttcacacaccctagcagagagcaacgggacagctagcgttccagtgactgtacctgaaggaactcatcctgatcaaacaagtgatcaagtgggaatcaatggaagcatgaacccatgcatccatccaatggtttctgcagacccaaaatttggtagtagtgccacaccacagacttttcctcataattatgctgcctttgctccaatgatgcagtgcaactgcaaccaagatacgtacaggtcattcaccaacatgtcatccacgttctccagcatgcttgtttccacgttgttgtcaaaccctgccatccatgcagctgccaggctcgcagcatcatactggccagcagctgaaggtaacactcctattgatccgaatcaagaaaaccctgcagatggcgtccaaggaaggaacataggctctcctccaagcatggcttctattgtagcagctacagttgctgcagcatctgcatggtgggcaacacaaggtcttctccctttcttcgctccacccgtggcttttccatttgtaccagctcctagtgctgcctttcccacagttgatgttccacgaccttcagagaaagacagagattgcccagttgaaaatgcacagaatgaatgccaagaagctcgaaaacaggtacagttcgaaggtttaagagttgctgcttcttcagagtctgatgggagtggaaaaggcgaggtgtctctccatacggagttaaagctatctcctgcccagaatgctgatgccacacctaccacaggagctggcacaaatgatgcattcaggaataagaaaaagcaggatcgctcttcatgcggttctaacacaccttcaagtagtgatgtagatgcgggcaatgttcctgaggaggacaatgctaatgagaaggcgaagcaagcctcctgcagcaactcttcagctggtgacactaaccaccgcagatttagaagcaatggaagcacaagtgattcatggaaggaagtttccgaagagggtcgtctggctttcgatgcgctgttcagtagggaaaagcttccgcaaagcttttctcccccacaagcagtagactcgaaggaggttgccaaggaggaggaagatgaagtgaccacagtggcagttgacctcaacaagaatgccacaagcattgatcatgatgacctcgacacaatggatgagcccagggcttcctttcccaatgaattgtcgcacctgaagctgaaatcgcgccgtacaggcttcaaaccatacaagagatgttctgtggaagcgaaggaaaaccgggtgccgactagcgacatggttggtaccaagaggattcgtcttgatagcgaagcatccacataattgatttcttcaaagttatatttacatctaagctactataggacttcagatcttgcaatgcagtgcttcattaaaactcaatctgttgtgtgctgtattttaatgcttgtcaagcagcccgctagactgctttaaaaccttatctcgtagactctgatttaagcatcatgcaactatcaaacttttttttggtcaaaatgtattttccttatgttttatatttttggaaaggaaaataattgaaatattatttatttt

SEQ ID NO: 8919 - DNA, 1574 bp, Zea mays
gaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagat

SEQ ID NO: 8920 - DNA, 1050 bp, Zea mays
aattaattggaagcacccagcgcacatcatcagtcgaagtgagcgtcagcgagcgaccgcaccggcacggcgcccatccatccatcgccatcctctagcccagtccaaaggaaccctagccatgagcgccgcctccaagaagctcttccaggccgccaggtccctcgtcctctccgcttctcaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggcgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggcgatcttgccattgttgttggaagaaacattattcatggaagtgatggcccagagacagcgaaggatgagatcgctttatggtttgaacccaaggagctggtctcttacaccagcaatgcggagaagtggatctatggggtgaattaacgagagagtcaatctgttttttttcccttcttttgatctcggttttcacataattgccgacagacctaggcacaaggatgtaataaagtcgctaccgtcacttcgagttggattgtgaccttcaggtgtagtaaggcacaaggaaggatggaaaggaaaggaatataccgtgaaatatagagcgtgcactgagtagtcgcgatgttcaaatc

SEQ ID NO: 8921 - DNA, 1757 bp, Zea mays
ctccacctctcctccggctagggtgttcacgcctgccgcggcgaagcttctgccctccccggcgtcgcgctctggtcgtcgtcggccgggaagatggctggcggcttcagggtacttcatctggtcaggccctttctggctttcttgccagaggtgcagagcgcggataggaagataccattcagagaaaaagttatctacactgttatttctctcttcatttttctggtgtgcagccagctcccactctatggcattcattcgacgactggagctgatcctttctactggatgcgtgttatcctcgcatcaaaccgtggcactgtgatggagttgggtattactccaattgtgacctctggtatggtaatgcaacttcttgtcggatcgaagatcattgaagttgacaacagtgtgagagaggatcgtgctctgctgaatggtgcacaaaagttgcttggtatcttgatcgctattggggaagctgtggcatatgtcctgtctggaatgtatggcagtgtaagccaacttggaacagggaatgctattctcattatacttcagcttttctttgctggcatcattgtcatctgtttggatgaacttctccagaaaggttatggtttgggatctggtatttctctgttcattgctaccaatatctgtgagaatatcatctggaaggcatttagccccacaaccatcaacagtggtcgtggtgctgaattcgaaggggctgtcattgcactgttccatctgttgattacgagaaccgataaagtccgtgctcttcgtgaggctttctaccgccagaaccttccaaatgtgaccaatttgcttgccactgtcttggtattcctcatagttatctatttccaaggcttccgtgttgtgcttccagtgagatcaaagaatgctcgtggccagcaaggctcatatccaattaagctgttctacacttcaaacatgcccatcattcttcactctgcgctgattaccaacctctattttatatcccagcttctctacaggaagtacagtggaaacttccttgttaaccttcttgggaagtggaaggagtctgaatactctggccattctattcctgttggtggtcttgcttactatgtaactgccccatcaagtttggctgatgtccttgcaaatccattccatgcactgttttatgtggtcttcatgctgtcagcctgtgctctgttctcaaagacatggattgaagtttctggttcatcagcaaaggatgttgctaagcagctcaaggaacaacaaatggtgatgccaggccatcgtgagtcgaacttgcagaaggaacttaaccgatacatccccactgccgctgcatttggtggtgtatgcattggcgcattgaccgtcctggctgatttcatgggtgcgattggttcaggaactggtatattgctcgctgtgacaatcatataccaatacttcgaaacctttgagaaggaaagggcgactgagcttggtttctttggtttttgattagtagctgtggaaccttaacttggctatagctgaattttcttgtaagtccctgtagtgcttagccagttgtaacttaaagagttctgtttaggttgccttcttgcggccacaatcatgtagcagaatgtgcgtgtgtttcaggttagcgtgggggtatgtgcatctgtccaaagagagtctgcaatttggcaaccggatattttgttatcaatttcagttacttcgaactgaac

SEQ ID NO: 8922 - DNA, 2335 bp, Zea mays
gggacgaggaggggaatccgggaatccaaagcagacggccagacgccgtgccgagccgagcagtccaactcccgggcagaggcagaggcagaggcggagggcggggcgagagagccgtgcggctgtccaactccccttccctatccggtagcagctgctcctatatgacccccgcaccccagcaaaaaccttcccctttttccccttcacagccccgtactactatccccgctaccgctagccgccgcgctgctcatctggtggcggctcgcctccctccccccatccgccgccgccggctcctcctctagctccctccttaccccgagctttaagctcgtgctacctgcctacctatccgtagggagagagagagagaggggagaaggttcggtcggtcggtcgggggctctcggatctcgccgctgcctccccgtttcttcgttgggatctcgctcgcttcgcgccatggccgccgtcgcgacgccaccggcccccgcgcccgccgcgccggcaccggcaccggcaccggctgctgctccggctcccgtcaccgtcgcccctgccgcggaccaaaccacggatctgctgcagaagttgtcgctggattcgcagcccaaggcggcgggtgcgacagagcctgctgctgctgccgctgccgccaaggagggtgctgtgacaaaccagccgctgagtgtggccatcccgccagagcggtctatcacgccggtgcttcaggactttatggatcccaacctgttcttcgatctcggcctagctagctagctagcgagcaagctatagcttagctcggctagccgggtgtgtcgccggtcggctaggcaacgccgctagcgatcgcaaaatggcagatgcgggggaggggcggcgggtgtgcggcatgccggagaaggcgcagctgcacgttgcgatgctggcgctgcagttcggctacgcgggcttccacgtggtgtcgcggctggcgctcaacatgggcatcagcaagctcgtcttccccgtctaccgcaacatcatcgcgctctgcctcctcgtgcccttcgcctactttctagagaagaaagacaggccgcagctgaccctcaacttcgtcgtccagtttttctttctcgcgctctgcggcatcacggcgaaccaagggttttacctcctgggcctggacaacacgtcgccgacgttcgcgtccgccatccagaactcggtcccggccatcaccttcgccatggccgcggcgctgcggatcgagaaggtccggctggaccgccgcgacggcgtagccaaggtggcgggcacgctggcgtgcgtggcgggggcatccgtcatcacgctctacaagggccccaccatcttcggtcccggcggcggcggcggcctcgagctggcgtcaaccagcaaggcggtggccggcgacaagaactggacgctgggttgcgtgtacctgatcgggcactgcctgtcgtggtccggctggctggtgctgcaggctcccgtgctgaagaagtacccggcacggctgtccgtcacctcctacacctgcttcttcggcgtcatccagttcctcatcatcgccgccttcatggagagggacgccgacgcatggaagttccactccggatccgagctcttcaccatcctatatgccgggttcatcgcgtccggggtggcgttcgcggtgcagatctggtgcatcgaccgcgggggcccggtgttcgtggcggtataccagccggtgcagacgctggtggtggccatcatggcgtcgctcaccatgggcgagaagttctacctgggcggcatcatcggcgccgtgctcatcatcgccggcctgtacctcgtgctctggggcaagagcgaggagagggcgcgcttcgccagggacgccgccaccctcgtctccggcagcggcgaccgcgaggggctccttccggccggcggcggtggcatccggagcgccagcaaggcggcagcgtcggccgccacgcagcctctcttgctgccgtcctccacctccaccgacaatgtctgatcggtcgacctatgaatccttcgtcgtcatccattgaccatggtgcgtggagataagagactgcatgcgtacgatccatgaggcgctgccatgcatgctgcgcgctctggtgcactcatggattggagcagtatgatccgatccagcagtaataattatcatcagctagtcttttttttgtggtttttccttgttgatttcacgcatgtatgtatgctgcaacctacatatatgcattactatggtgtgtgtgtggtgagagcagacgacggcaaggtttattttaacttc

SEQ ID NO: 8923 - DNA, 1174 bp, Zea mays
cactgctccgtctcccggcctctcgcctctcggcctctccatcgttcgacctcgcgacgcgtcaagtaggggggcggcggccttcgcggagatgaccaccttcctgatcaccggaggcgatttcccgcgacactcctcccccctccccgtgctctgctagacagatagatccgggctcttccttgatttgttcggtgaggacatcatgtggagttttgcatcaaatgccatagctggaagcttaaagaaaaaagcacaaccctcaaaatgcagcatatccaatgcagattattctgatgatgaagtttcttcatgtacaagcagagaggaaggccttgattgtccaatatgctgggaatccttcaacctcgtggagaatgttccctatgtcttgtggtgtggccacacaatgtgcaaaaactgcatccttggtcttcactgggcagttgtcaagttcccgtcccttcctatccagctgcctttgttcatctcatgcccctggtgcaacctgctgtctttccgcctggtttacaagggcaacctcaggttcccacgcaagaactactttctgctctggatggtcgagagcatgaacggtgggagagcaaaattccattccactaaccatgacgagcatcattccacgtggcattcaagtgccggcacaagctccagccatcaacagcgaagaaatgctgctgtaggatcagagagctcttctggcagagagacaggcgtaggccgcaacattttccacaccgacaacattagtgcttctctgcaaaagcttatggtgtgcttcatgcagctgacggccaagttcccactcgtgataatctttctgctgatagtcctttatgctgtccctgcaagtgctgctgttctggttctctacgcccttgtcacgtttttgtttgcactgccctcatttttgatcctctactttgcctaccccagcttggattggcttgtcagagagatcttcgcttaattcgtgctgtctgaaatgtccgcgcagtttgtatccctgcgacaaatgatatatatcggtatatgtattccatgggccacctgccctcgtaggccctgtatagtttcttcttattctctgtccttgtagcactctatttctgttgtaactaacagcttattaaaaatgctctgcaatgctttt

SEQ ID NO: 8924 - DNA, 1956 bp, Zea mays
ctcgagtagttccctctcctctctgcttctcggcctagctagctagctcggtgcctcggccaaccgggcgtcgcgcgctggccggccggcctgccaggcgagaactagctagcagcgcaagcaacaatggcagattcaggggaggggcgtcgggtgtgcggcatgccggagaaggcgcagctgcacgtggcgatgctgctgctgcagttcggctacgcgggcttccacgtggtgtcgcggctggcgctcaacatgggcatcagcaagctcgtcttccccgtctaccgcaacatcatcgcgctctgcctgctcgtgcccttcgcctactttctcgagaagaaggacaggccgcagctgaccctcaacttcgtcgtccagttcttccttctcgcgctctgcggcatcacggcgaaccaagggttctacctgctgggcctggacaacacgtcgccgacgttcgcgtccgccatccagaactcggtcccggccatcaccttcgccatggccgcggcgctgcggatcgagaaggtccggctggaccgccgcgacggcgtggccaaggtggcgggcacgctggcgtgcgtggcgggcgcgtccgtcatcacgctctacaagggccccaccatcttcggtcccagcggcagcggcggcggcggcggcctcgagctggcggcggtgggcggcgacaagaactggacgctggggtgcgtgtacctgatcgggcactgcctgtcgtggtcgggctggctggtgctgcaggcccccgtgctgaagaagtacccggcgcggctgtccgtcacctcctacacctgcttcttcggcgtcatccagttcctcgtcatcgccgccttcatggagagggacgcggaggcctggaagttccactccggatccgagctcttcaccatcctatacgccgtcagtatatatcgatctctctacttattagcttaattacaataatatatatatgtacagagaaagagaatgagagacacacatgccctcctgacgcgcgcggcaaaagtggtggtgcaccacgcaacaacactaagctaatagctatagctagctgtgcaaatgacgcccggcctttttccattcagtactgtattattatgaactgaaaagctggtggctgggttaattattagttgtttatcgatcatcagatccctgaagcaacaaccttttggaagctagactgatgatgttcttgtgcatgcctgcaggggttcatcgcgtccggggtggcgttcgcggtgcagatctggtgcatcgaccgtggggggccggtgttcgtggcggtgtaccagccggtgcagacgctggtggtggccatcatggcgtcgctcaccctgggcgagaagttctacctggggggcatcatcggcgccgtgctcatcgtcgccggcctctacctcgtgctctggggcaagagcgaggagagggcgcgcgtcgccagggacgccgtctccggcggcgaccgcgaggggctccttgtcgcggcagccgccggaggtggtggcggcggcatcatcaggagcgccggcaataaggtggcgtcggccgcgacgcagcctctcctgctgccgtcctccacctccactgacaacgtctgaccgatccatggatggatgaatcgtcatccatgcttgcttggtgcgtggagatctgaggcagcatgcagaattaccagttattagtcatttctttgaggttttcccctgttgattttcacgcatgtatgtatgctgctacctacgtgtacgtacgtatatgcatgcatcactatggttgttttacgcctttgatcacaagacaactacgtagctaggatcgtcggagtgtgttgacgacgtttggtatgtgcatgcgcaatgcagtgcagtgctagctcatcacaggaagtgtgtgtaataatattagtttgcaggtataattatgcgtttgatt

SEQ ID NO: 8925 - DNA, 1973 bp, Zea mays
ggctccgaatcggcggccacttctcattcctcacttccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtagcatcgtgcgtgatgtaagggatggtttcgggagcttgtctaggaggggatttgaggtcaggtttctgagtcatcgcagagggaaatctcatggtgctgtccatgagctgcacgacccagtgcttgtggtacagagtagctgctgggctagcttgcctcctgaattacttcgagatgtgattgagaggttggagaccagtgaggatacatggccttctaggaaacatgtagttgcttgtgcagctgtctgcagaacatggagagagatgtgtagagagattgtcaagagcccagagttttctggaaaaatcacttttcctgtttccttgaagcagcctgggcctcgagatggaactattcagtgttttattaagagggataaatctacccaaatctacagtctgtaccttagttttagctctgccgtgcctgtcgaaaatggcaaattccttctatccgcaaaaaggaactgccgtgcaacatatacagaatatataatatcaataaattctggtgatacatctaggtgtacaagtaacaacacatacattgggaaattaaggtcaaatttccttggcacaaaatttgtaatatacgatactcatccgccatacaatggaactagtcaaacagtggcagggaaaacaagtcagagattctactccaagaagggatcaaccaaggtttcttgcaggtggtacagtattgcacaaatctcatacgagctgaatgtcttgggaactcgaggcccaaggcggatgaactgtgtaatgcactccatcccagcttcatgccttgaggctggtggcagtgtcccttgccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtggcacgagcagcttcagtgctggtgcctcaacttccggggccgggtgactgtcgcctcggtcaagaacttccagctagtcgcggcgacacagcctgccgccggagccctgaccccatcacaggcagccccgcagccagctccgcctcctccgccggaccaagagaaggtcatactgcagtttgggaaggtcggcaaggacatcttcaccatggactactgctacccgctgtcagccttccaggccttcgccatctgcctgagcagcttcgacaccaagttggcctgcgaataaatcctacctacaattctggtacctaccaaataatcaaaaacactgattgtcgtggtgttcgtccaagaaccgagtttagctgagacgccattgggcaccatgtgctggtgccttgttaactcagaaacgcgtgggggctgaatctgtttcagcagcttccttgtgataatctgtagctgctgcttcgctgctgttgtatcctatgctttcatttctttccggttccgctgtagcttcttaccccccggtgacattagttcggtacccgtatctggatatttttttagccttcttcgttggattgttcaccggtgatggcatgtattaacagagatagttacatacagatgtaatgaattcaggtctggat

SEQ ID NO: 8926 - DNA, 1882 bp, Zea mays
cccattcgcatccgcctccttttccttggagccgaagaagagggaaaggaagggaggacagccgccgccgccgccatcaccaccgtcaggatgcattccacgaacctcctgctcgaggagcccatccggatggcctccatcctcgagccctccaagcccagctacttcccggcgatgaccaagatcgtcggcactctcggccccaagtcgcgctccgtcgacacgatctccgcctgcctcaaggccggcatgtccgtcgcccggttcgatttctcgtggggggacgccgcgtaccaccaggagacgctggagaacctcaagctctccatcaagtccaccaagaagctctgcgctgtcatgctcgacaccgtgggcccggagctgcaggtggtgaacaagagcgagaccccgatctccctcgaggagaatggcacggtcgttctcacccctcaccggggccaagacgcctcctccagcttgctgcccatcaacttctctggactcgccaaggcggtgacaccaggggcaacaatattcgtgggacaatacttgttcactggcagtgagaccacctcagtttggttggaggtttctgaagtgaaaggagatgatgtggtgtgtataatcaagaacacagccaccttggctgggtcactgttcacgctgcattgctcccagattcacattgacttgcccaccctgtctgatgaggataaggatgtcattagaaaatggggtactcccaataagattgacttcctttctctgtcctacacaagacatgcagaggatgtgcgccaggcacgggaattcctgtcaaaattgggcgatctaagccagactctgatttttgccaaaattgagaatgtcgagggcctgaaccaatttgatgaaatactggctgaggcagatggtatcattttatcaagagggaacctgggaattgatcttccacctgagaaggtctttttgtttcaaaaatctgctcttcacaagtgcaacatggctggaaagcctgctgttgtcactcgtgttgtggacagtatgactgacaacctcaggcctactcgggcggaggcaactgatgtggccaatgcagtacttgacgggagtgatgccattctccttggtgctgagactcttcgaggtttatatccagttgagactatttcgacagtgggcagaatttgtgctgaggctgagaaggtattcaaccaagatttatacttcaagcaaactgtgaaatatgtcggagaacccatgacccacttggagtccattgcttcctcagcggtgcgagctgctatcaaagttaaggcttcggtgatcatttgcttcacctcttctgggagggctgcaaggctcatcgccaagtacaggcccaccatgcctgttctttctgttgtcattcctcgtctgaagacaaaccaactgagatggagtttcactggtgcttttgaggcaagacagtcgctgatagttagaggcctctttccgatgcttgctgatcctcggcatccagccgaatcaaccagtaatacaaatgagtcagttctgaaggttgctctagaccatggcaaggcatgtggtgtgatcaagtcccatgaccgtgttgtcgtttgccagaaggtgggagattcatcggttgtgaagatcattgagctggacgactagggcatactttgccgattttttttttttgacgaggccggaatttgttggctatatgtataatcctatagctttctttacaaatgagcagtttttccctatggtgccatcataggacttgcttagcgatttaaaactcgattatgtgccacctaaaatgggcagatggaacaatgaaatcatactgtgccctttatccgttgctattgtt

SEQ ID NO: 8927 - DNA, 1514 bp, Zea mays
ccaaaggaggcggccggccgtgcccacatgtcacggaaatcatgtagcatcaccgtgcgtacgtccaccaaccaccgtcgaacacgaggagggtgacaggtgggccatccgaggtttgggcgagccaaacaaaaaccctcttcacaccggtcaccacttcatctcgcccacacgaactcgagacctcgcccgcccaaatacgaaagcctcagatctcagtgaccagcgccgccgcttcgttcgtgtcgaggggagaagaggaaatggcggcgagcgagggcgtgctcctggggatgggcaaccccctcctcgacatctccgccgttgtcgatgacgccttcctagcaaagtatgacatcaagctgaacaatgccattctcgctgaggagaagcacttgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggtgaaaggtcattgattgcaaatctgtcggcggcaaactgttacaaatctgagcatctcaagagaccagagaactgggcactagttgagaaggcaaaatacatctacattgctggatttttccttacggtgtcacctgattctatccagttagttgctgagcatgctgcaacaaataacaaggtgttcctcatgaacctctctgctcccttcatctgtgagtttttctgtgatgcccaagagaaggtcctcccgtatgctgacttcatcttcggcaatgaaaccgaggcaaaaatcttcgccaaagttcgaggatgggagacagagaatgtcgaggagattgctttgaagatctctcagcttcctttggcttcaggcaagcaaaagaggactgctgtgattactcaaggcgctgatccagtggttgttgctgaggatgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgccgccaatgttatcatccagcgcccaggttgtacctacccagagaagcctgacttcaactagtgcaatactcaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatgcttgcaatgcgacgagaatgcgttggaaccatatatgcaatgcaaagttagc

SEQ ID NO: 8928 - DNA, 1572 bp, Zea mays
caactcatcgggcgcggagaccaccgcggggggaaaagcgagggaggggggagaggactgaagagaaatcatggagccgatttgctgtggagattcgggcgcgtgatccggtcggatcttgctttcccggggggcgatcgaggccacgccgctgctgccgcggtgccctccctctgcctctgggctctgcgtgtgacgtgccgtgccatggcgctcgccctcgcctatatccccagcctccctcgccccgccgctggccgccgcattcagtaaaaagccacctaccctaccctcctgcgctggtactacttactacctagccaggccaaggagcccaacgagggggaacgctgcggtaggcgcgcgctgctcgtcccaccccacgccgccatgacggtgccagatgccgagtcgcgcttccatgtcctcgcggtggacgacagcctcgtcgacaggaaactcatcgagatgctgctcaagacctcgtcctaccaagtgaccacggtggattccgggagcaaggcgctggagctgctggggctgagggacgcgtcgtcgccgtctccgtcctcgcctgaccaccaggagatcgacgtgaatctcatcatcactgactactgcatgccaggcatgacaggatacgatctgctcaagagagtgaaggggtcctcctcgctcaaggacattcctgtggtgatcatgtcgtctgagaatgtgcctgcccggatcagcaggtgcttgcaagacggcgcggaggagttcttcctgaagcccgtgaagctggccgacatgaagaagctcaagtcgcacctgctgaaacggaagcagcccaaggaggcgcaggcgcaggcgcaggcgcaggcgcagcagggacaggcggtggagctggagcctgagcagcagctggacccgcgcacgcagccggcgcacgacgcggaggaaaccgcggcagagccgccgccggccgcatccaacggaaccaccgatggcggcaacaagaggaaggcggcagccatggaggaggaggggatgctggccgtgatgacggtggcggcgccggagagcagcaccaagccgaggctgtccaccaccaccagcagcctggcggtggaaacctgagctgagaatcggacggcgaccggatcacatactactacctacgtacattaatccaccattgcgggcagtcgagaggcaaccaaccaaccaagaaccaaccgaccaaacccaggccaccgccgagaaagagctcgtcctccttttctttcgctggttcttttggttctcggagctaattaatggaatgaaggtgtgagctcctggggatggaggggcggttacgggctctaagtgaagaacaattacgacgtaccttacctagcggctgctgcttcggccggcaaattttgttgtgctcgtggtcatggacacccttgtgttcgttaggagggggtcggggtggaacggtgaaaaggaagctgtagatagaaaaggcaggcgtctcatgctcttgttgtctagtctaatttttaattttactcggcttattaatcacggtactgactagctgcc

SEQ ID NO: 8929 - DNA, 2085 bp, Zea mays
cgtcagcccctctctctcccggcgtggggtggccatagcttcgctgcctccacttgtcttctttgtttcaccatcagttcaattcagtttctcgccggtcgccgctggcttgctagttgctactgcgcgcacttcagctgcccgctgttgtaccgcggactctacctcatcattcgccttgctgcctccgccgcctaggtcgcgcaggttcggacgccatgaccgcgacgccggcggtgatcgggctgagcgcccgcggcaaccgcctcctggccacctcattcggttccgctgagctcgctcccccggacgcgtacccgtcgcggcagttcgccgccgcagcgcccaagctcaccgtcgtggcgcaccgcgcctccgcctccgcctcctccccggccgacatcgggggcgccggccacgcgcgcgcgcacgccatccgggcgctcaggaaccactccgcgccggcgctggccccgcctcctccggctgacccggctccggagctggactccaagttcgagttcgagttcgagtcctcgctggaggccatcgtgctgctgcagcgctccatgctcgagaagcagtgggagctgcccttcgaggacgacatctcctccacggaggacgaggacgaggacgagaggtccacggtggtggtggcgcggtcgggcgtctcggcgcggcagcggcggatgagcgggcggcggcggggcgctgtcgttggccggaagagcgtcaccgtcagcccggagctgatgcagagccggaaccgcatctacctccggggcaccgtcagcaaggacctcctcacgcacaagcaggtcgtccagctctccaggaagatcaaggacggcatctggcttcagcaccaaagatccaagctgaaggagaaactgggcaacgagccgtcatacaagcagctggcgcaatcgctgcggataccagctcctgagctgcgagcgaggatgcgcgagtcgtttcttgcgagggagatgctggcgatgagcaacacccgtctggtgatatccattgcccagaagtacgacaacctcggcgtcgagctgccagaccttattcagggtggtctgatagggctgctccgtgggatcgagaagtttgatgcctcaagggggtttaggatctccacctacgtgtattggtggatccgtcagggggtttcaagagcattggccgacaactcgagatcgttcaggctccctacttatttgcacgagaggttggtagccattcgcggcgcaaagtacgcgttagaagaccaaggaattgctccgacagtagagaacatagcggagtcgctcaacatatccgagaagaaagtgcacaacgctacagaggctgtgcacaaggttatttcactggatcaacaggcgttcccctccttaaacggcctacctggggatacactccatagttacatagaggatcaaaacgttgcaaatgatccgtggcacggatttgaggaaaggtacctcaaggaggaagttaacagtcttataaattcaactctcaacgagcgcgagagggacattattcgattatatcatggcataggaaagcagtgccatacatgggaggatatcagcagacaattcgggttgtcgagggagcgcgtgaggcaggtagggctcgttgcgatggagaagctgaagcatgctgcaaggagggaacatttggatgcgttgcttgaggaatactgagtgagatgttcttcgcttgagtcggttaattccaccgttgcagtggttgtatatactcggaaacataggggggcaggcacatcatccttgaaaggcttcactgccactcactcactctgcagataactatacatgtacatctgtgacgatcagtaggcatgcatagttaaagcatctgtggctgcaaaatcgtcaaggcgatccaacaaaaggagaaccttttttttggtcttggaagctttacaaagtgtgatgtggtatgtatatgcaaatgtaatgtatcagtaattcagtagagcaataacgtttatgtcctggatttgtattcttgtccagttacatagaaggaaaaaatgcttacaactgc

SEQ ID NO: 8930 - DNA, 2876 bp, Zea mays
cggatcaagggacgggcagggaagccgctcccgcctctgttgtcccgatccacgggaacctgacgcagttgatacgccaaatcaaatcgaggcgcctcttgtacatcaaggagaaattggaggcgaacaggaagacgctgcagaggcactcctgcgcgctgttcgacgtggcagcggcggcggaggtggcgtcgaggggcagcgatggcggcaacgctttgtcgcagcgagcggcggagggacagttcaggctcgctgggtcagacctggcacacgggataggggagagggacgtggtgtacatgcaggaggagaacctggcgtccgggacgctcgtgctctccagctcgggcgctgccgcgcagcggacagtcgtgcggttcgtgaagctgccgttggttgagaggatccctccgtacaccacttggatcttcctggacaaaaatcaaagaatggctgatgatcagtcagttgttggtaggagaagaatttactatgatccaatcggaaacgaggctctgatctgcagtgacagcgatgaagaaattccagaaccagaggaagagaaacactttttcacagagggagaagatcaattgatatggagagctactcaagagcatgggttaaaccgagaggttgttaatgtcctctgccagtttattgattcaactccatcagaaattgaggaaagatctgaagtcctatttgagaaaaatgagaaaaactctggatcttcagataagatagagaggcaactttctcttgacaaaactatggatgccgttctggattcttttgataatctcttctgccgcagatgcttggtttttgattgtcgcctccatggttgctcacagaatttggtattcccaagtgagaagcaaccctacagctttgagcctgatgaaaacaagaagccatgtggtcgtcagtgctaccttcgatggagagaaggatttcaagagattcatgatgttggtcttagtggctgtgcaacatataatatggaatcaggaactgtctcacacaaagttgatgttagtattatgtctgaatcagaagattcaaaccgtgagaaaggcaacattaggtccatgacactagttggaaccagtggatcaaaaataatttcttctgttagtgctgaagaaagcactactccgccttcagcagatacctctgaaacagagaatgcatcctctgatatgcctcccagtagtttaaggaaatacaagatttcaaaacgtggacctaggtacagggagcgttctcctggcaaaaggcagaaggtttttacttatgacatttcttttgcaagcaatatactgaataaactttcgattccggagattcgcgacacaagactagagtctagagaacctggaggtgataaactacaaattcttgacgagtccactaagaaaacttcaagcaaagatatctgtggagaaagcccaattactactactgaaaatgtgggaagagagagtaaaaaagtatcttcaacaaagaatttcttggagcacactctttcatgttggagtgccttagagcgagatctatacttgaagggcatagagatatttggaaagaacagctgtctcattgccagaaacttactatctggtatgaagacctgcatggaagtggccaactacatgtataacaatggtgcagcaatggcgaagagacctctcttgaataaatccatctcaggcgactttgcagaaactgaacaagactacatggagcaagacatggttgccagaacaagaatctatcgtcggaggggccgcaatcgaaagctgaaatatacttggaagtctgcagggcatccaactgttagaaaaagaattggtgatgggaagcaatggtacacacaatataacccatgcgtgtgccagcaaatgtgtggtaaagattgcccctgtgtggaaaatggaacttgctgcgaaaagtactgtgggtgttcgaagagctgcaaaaacaagtttagaggctgtcattgtgcaaaaagtcaatgcagaagcagacagtgcccctgttttgcagccagtcgtgaatgtgatccagatgtttgtaggaattgttgggtgagctgtggagatggttcactaggtgagccacctgccagaggtgatggttatcagtgtggaaatatgaagctccttttgaaacaacaacaaaggattttgttaggaagatctgatgttgcaggttggggtgcattcatcaagaatcctgtaaataaaaatgattatcttggagaatatactggtgaattgatctctcacaaggaagcagacaaacgtggcaaaatttatgaccgggcaaactcatcatttctgtttgatttaaatgaccagtatgtgttggatgcttatcgcaagggggacaaattaaagtttgcaaatcactcatctaaccccaactgctatgcaaaggtgatgctggtggctggcgaccatcgggttggtatctatgcgaaggagcatattgaggctagtgaggaactcttctatgattatcgttatgggcctgaccaggctccagcttgggctaggagacccgaagggtcaaagaaggacgaagcatccgtctctcaccatcgagcacacaaagttgctcgatagctgaagagcagctccggatgatacaatatgcagtaaattatatatttaatacatgatttagtcctagttcattatacgaggacttcgttggtagataagcatattgtatattcattagtgaataaactcccatacatcaagttggggaataagtgcatataaatattttttaccttaggtcggaaggtgacaaactgacaaccttgttaggttgagtaaagttagtgcttacaggttttc

SEQ ID NO: 8931 - DNA, 872 bp, Zea mays
ctggtgggcttctcttgcgtgacctactacacgtcggcgctgctcgcagactgctaccgctacccggaccccgtccacggcgccgtcaaccgcgagtacatcgacgccgtccgatgctacctggaccggaagaacgtggtgctgtgcgggtgcgcccagtacgtgaacctgtggggcactctcgtcggctacaccatcaccgccagcgcaagcatgatcgcgattaagcgcgtcaactgcttccaccgggacggctacggcgccgccggctgcaacccgtcggggagcacgtacatggtggtgttcggtctcttccagctcctgctgtcgcagctgcccagcctcctccgcacgtcgtcctcgtcgcccccgcccaccctgcccgtcgcgccgctcaagctcgtcctgcgcaccatcgtcatcatgttcaccacgctcgtcgccatgctgctgcccttcttcaacgccgtgctcggcctcatcggcgcgctcggcttctggccgctctccgtctacttccccgtcagcatgcacatggccaggctcaacatccgacgcggagagatccgctggtggatgctgcaggccatgagcttcgtctgcctcctcatctccgtcgccgccagcatcggatccgtgcacgacatcgtgcacaacctcaaggccgccgcgccattcaacaccgcaaactgattaataaccatgcatttactagtatatatacggatcggaggagtgatgggttaattagtttcttaattagctttggctactatatcagtataagaggagcagagggccggccacatgcatggcctttttgtgtttcttgattatctggcaaatttgatctgtcgagcagattttcatgc

SEQ ID NO: 8932 - DNA, 1749 bp, Zea mays
ggtagaagaagcaacgacggtcaagggcctagctatttgttaactctggcccctcacctgctccccttctgtccagcccacgggagggcgactagggttaggggcgaccggaggtcgccgcgcctgcccaaatccacccatcccttccgttcaagccgccggagctcccaggccgctggtgtcgaagccggcgtcccttccttacaggcccgcctcctctctgtccgttctgtcttggtcgacgaagctcaagaccacagtgtcaggaagctctccaatcttccagccaaacacaattcatcagtcagatacacttttaccaaggaatttttcagaatcactccacgagaggttcagctctcgaagctagagaaccagagctctaccaaacaggccaggacgtctctcaaatccccagttcagtaactggctaactgtaggagaaggagagagatggagaacggcggcgctaaacgcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattgttgagaggttggctactgtgaaacacaaattgttagttttgtctggaaagggaggtgttggaaaaagcacattctcagcccaactctcgtttgccctagctgaaatggaccatcaggttggccttcttgacatagatatatgtggccctagcatccctaaaatgctaggccttgaaggacaagatattcatcaaagcaaccttggctggtcacctgtgtatgttgagtccaaccttggtgtgatgtcgattggtttcatgctgcctaatccagacgatgctgtcatatggaggggtccccgcaagaatggactgatcaagcagttcttaaaggatgtcgattggggggagattgactatcttgttgtggacgctcctccaggaacatctgatgagcacatctcgatcgtgcaataccttcaagccacaggaatcgatggcgcgataatcgtcacgactccgcagcaggtctctctgattgacgtgaggaaggagataaacttctgcaagaaggtcggtgttcctgtcctaggtgttgtggagaacatgagtggcctgaggcagccgctttcagacctcagattcattaagtcagatgaggcgggcgagacagatgcgacagaatgggccctgaactacatcaaggagaaagcccctgagcttctgtcggtcgtggcctgcagtgaggtatttgatagcagcaagggaggcgccgagaagatgtgccatgaaatgggggttcctttccttggtaaggtgcccatggatccgcagctgtgcaaggcggctgaggaagggaggtcatgctttgctgatcagaaatgcagtgccagtgcgccggctcttcggaacatcgtgaagaagctgatcaaggccgagggagaaaatagtgttggcctgctggggaatctggtagtgagaaatgagatgaaatgacagatgccagagttctcgttaccaatatatatatatgttacggcgttacacactgaatctgtattagtgctagtgttggatctgtaagtttttgttcgtgaataatcagtgggtgcacagactattaagtggactatgttttgaggcgctgcttgaatgatctgtactgtacgtaggggagtgtacggtgttagc

SEQ ID NO: 8933 - DNA, 1074 bp, Zea mays
cgtcagcgagcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatcaggggtgatcttgccattgttgttggaagaaacatcattcatggaagtgatggcccagagacagcgaaggatgagatcgctttatggtttgaacccaaggagctggtctcttacaccagcaatgcggagaagtggatctatggggtgaattaacgagagagtcaatctgttttttttccttcttttgatctcggttttcacataattgccgacagacctaggcacaaggatgtaataaagtcgctaccgtcacttctgagttggattgtgaccttcaggtgtagtaaggcacaaggaaggatggaaaggaaaggaatataccgtgaaatatagagcgtgcactgagtagtcgcgatgttcaaatcaaactatatatcaccgtcactggagtcatgtaatccaagatggtgatgcagatgtttctttggatct

SEQ ID NO: 8934 - DNA, 1903 bp, Zea mays
gtctcttcttcccacttccttccacttcttgtccctgctcctgttggttttagcatcctgctcggccgaatgctggatcagaggctgcagcaaaggtagtaagtcgcttctcgtatttcccgtcgagagagggacagggggggagaacccccaaccgaggcgctgcaagttccccacggccggggcgggcttctcttgcgggaacatgaggaagctgttgttcatctccttcgtcctctcgctgtccgctgcagcagttcacggtgaagacggtgcgtacattggcgtgaacattggcacggccatgtcgtcggtgccagcgccgacgcagatcaccacgctgctccggtcgcagaacatccggcacgtgcgcctctacgacgcggacccggcgatgctggcggcgctgtccaacaccggcatccgcgtcatcgtgtccgtgcccaacgagcagctgctggccatcggcaactcgaacgcgacggcggccaactgggtggcgcgcaacgtggccgcgcacttccccgccgtgaacatcacggccatcgccgtggggtccgaggtgctgtcggcgcagccgagcgcggcgccgctgctcatgcccgccatgcgctacctccagaacgcgctggtggccgcggcgctggaccggtacatcaaggtctcgacgccgcactcgtcgtccatcatcctcgactcgttcccgccgtcccaggccttcttcaaccggtcgctggacggcgtgctggtgccgatgctcaggttcctgcagtccacggggtcgccgctcatgctcaacgtgtacccttactacgactacatgcggtccaacggcgtcatcccgctggactacgcgctgttccggccgctgccgcccaacaaggaggccgtggacgccaacaccctgctgcactacaccaacgtgttcgacgcggtggtggacgccgcctacttcgccatggcgtacctgaacgtcaccaacgtgccggtgatggtgacggagaccgggtggccgcacaagggcgactcctcctccgagcccgacgccacctccgacaacgccgacacgtacaacagcaacctcatccggcacgtgatgaacagcactggcacgccgaagcaccccggggtggccgtgccgacctacgtctacgagctgtacgacgaggacacccgcccgggctccacgtcggagaagtactggggcctgttcgacatggatggcgtccctgcctacaccctgcacctgacgggctccggcgtcctgctggccaacgacacgacgaaccagacctactgcgtggcgcgggagggcgcggaccccaagatgctgcaggcggcgctggactgggcgtgcggccccgggaaggtggactgctccgtgctgatgcagggccagccgtgctacgacccggacaccgtggacgcgcacgccacgtacgccttcaacgcctactaccacggcatgggaatgggctccgggacgtgctacttcagcggcgtcgcggtggtcacgacgaccgacccgagtcacggatcttgtgtttatgctgggaagaacgggacgtcgttgatgaacggcacctccctggcgccgtcgtccaactccacggagggaggctccggcgcgcaccgggcgttcggcgacgtctcgtcactcgtccgcatcgtctccaccgcgctgctcttcagcgtcgtcctcctcctgttgtaggcagtagttagtactagaggtagaaggcaccttggaatggaaccatgcagtctttgcagaattaggcattcgtgagggagagggagggatgattctttttgctgtcaagtggcgggccgggaacgttctgatgatgtattctcccgtctggtattggtatggtatggaacaaaaattggtttgcatccc

SEQ ID NO: 8935 - DNA, 1769 bp, Zea mays
gacttccctggctgtcatggacaagcgcattatgccctcacgagataagttaacagggctagctgctaggtggttgctgcatactggtcttccctctttctcttgccacctcgggcatcctctctggcttagaaaaaaaatatgcgcttcatagtccatacctagatcttttggtgttcagttttggtttcaagccatggcgaattctcggattggacgttacaagatgtctactctctcagacccctcaaaagaagatacttcacctgagggttcaggtactacccagagaaatggagcctggagtaacacattgaacactcttctgcagcaagcctcagtatatggtgtggccgctgggtattgtttatcagcgtccctgctctcgatcatcaataaatgggcaatcatgaaatttccatatcctggagccctgacagctctgcagtacttcactagtgttgctggagttctcctatgtggacagctcaagctcattgagcacgatggacttaacttgaggacaatgtggaagttcttacctgctgctgtgatgttctacatctccatcttcacaaatagtgaactcctgcttcatgccaatgtggatactttcattgtgttccgctctgctgtgcctatatttgtcgcgatcggagagacgctgtatcttcatcagccatggccatcgctcaagacatggctttcactctccacaatacttggtggaagtgtgatctatgttttcacagacaaccaattcactgtgactgcttacacctgggcagtggcctacctagcaagcatgtccattgatttcgtgtacatcaagcacgtcgtaatgaccattgggctgaacacatggggccttgtgctatacaacaatctcgaggctttgatgttattcccccttgagctccttataatgggagaatttgatcagatgaaggtcgacagctccaaggtgtcaaactggctgtcattcgatgtggtcctccctgttgctctttcatgcctgtttggactatcgatatcattctttggattctcctgcagacgggctatttctgctaccgggttcacagtgcttggcatagtgaacaagctcctgactgttgttattaatttgcttatctgggacaagcatgcctcttttgtgggcaccattgggctcttgatatgcatgtcaggtggcgtgctctaccagcaatccaccatgaagccgaaggcgcccaaggttgagccgaaggaagagaacgacaacgacgaggagcagcagaaattgctgcagatgcagggtgttcaagagagcaatccaactcagaaataaagctcttcataaaccttacaacgaagtaatgctttgatggattaccttctttgcaacagcctcacctgaaacgtttttgtattggctaatacttggaaaaaagcatatggatgagtagtcatgaattaggagctacaaaatatcatgtttttgatattagaagtcgtgaggggacctaattatcactatgcaattctttattactgtattaccacttacatttgtaacgcaaaatcgttatgataggataccaggtactcggcaaatacctgcattgaatacttcctatacaaaagcatccgtctcatacagttcgggggtgacagtggtagtatgatctgtttttaggcatttctctgctggagttagcctatatgttctgtaacttattgttggtgatgaagacattggttcttgtgctaaatagagttttcttatc

SEQ ID NO: 8936 - DNA, 1421 bp, Zea mays
gccagcagcagcccatccgaccccccgcctcctcctcctcctcctcccgggttcgcgtgaggctgtgtgctgctgggaggcggcgccggcgccggcgccatggaggcggagaagaagccgccggcggtgtccgacgtgggcgcgtgggcgatgaacgtcgtcagctccgtcagcctcatcatggccaacaagcagctcatgtcctcctccggctacgccttcgccttcgccaccacgctcaccgggttccacttcaccgtcacggcgctcgtcgggtggatctccaacgccaccggctactccgtctccaagcacgtcccgctctgggagctcgtctggttctcgctcgtcgccaacacctccatcaccgggatgaacctcagcctcatgctcaactccgtcggattctaccagatctccaaactgagcatgattccggtggtctgcctcatggaatgggtgctcaacagcaagcactacaccactaaggtcatatcggcagtcaccgtcgtggccgccggtgtcgggatttgtactgtcacggatgtcgaggtcaatgccaaggggttcatctgcgcttgcgtggcagtgttctgcacgtcgcttcaacagattacaattggctcctttcagaagaagtacaacattggatcatttgagctgctgagcaaaactgcgccaattcaggcactttcactcattatactgggcccctttgtggactactatctaaatggacggtcattgttgaactaccctttttcaggaggggcaactttcttcatactgctttcctgctccctggccgtgttctgcaacatgagccaatacctctgcatcgggcggttctcagcgacctcgttccaggtcctgggccacatgaagaccgtgtgcgtgctgatcctgggctggatcctgtttgactcggccctcaccgtgaagaacatcctcgggatgctgctcgccgtgatgggcatggtggtctacagctgggccgtggaagcggagaagaaggcggcagccccgatcccccggaacaagggcggcatgctcgacggcgaggacgtgcccctcaaggccagggtgagcggcgtgcccgcggtcgacctcgaggacggcgacgtgaagggctagccgctgatccgttcattcttctcgttcttttgtaactgtgcgcgcgcggtcgctcgatgcaaagttgcttgttcgtcggttctcagctatcgacactacactgttaattttgttggccccttgttggggggagtctgctcgtaggtgaccccccccccccctcccccgggttcgacgtagatgaaacacacgcgggcagattgttaggatttttcaggcggggaggtggcgacatgctgttatagatggtgacaagactttatataatggaaatgcaggtgtttttg

SEQ ID NO: 8937 - DNA, 734 bp, Zea mays
cggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtctcgtttgttgttgcccatctgtgtttttgattgcaaggtcgctctgtgtcagttgttagtgctgtgttcatcctcggctccagcagacccatgcatcaaccagcatggactgtggatcgatggatgctgttactcctgtcaggatttgttctaagttaatcctaaggaaaaaatggtgcttcttggtgctgc

SEQ ID NO: 8938 - DNA, 829 bp, Zea mays
cttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggtt

SEQ ID NO: 8939 - DNA, 1817 bp, Zea mays
ctcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatttgtcgtttatgaat

SEQ ID NO: 8940 - DNA, 1869 bp, Zea mays
ccccaccgtcgcctcgctcgacctccacctctctttcctcccggcagcaatggaggcggcacccaggtgaggcgagcaagcagccagccctggctccccgatggcgtgcctggcgccgcagttcaagtgggcgccgtcggccgccgcccacatgccttcctcgtcctcgtcctcgtcctactccaggtgctccgcgctccgcgtccactgcgccgtcacctccgccgctgtcgtcgaggaccgcaccaacggcagcgcggcgcagctgaggctcgcttacgcggctccggcgattcagagaaactttgaggcaactctggcatcagaagcacttctaaatgaagaggcggtagtagcagcggcagccgcagaggctgttgctcttgccagagcagctgccgaagctgcccaagaagttgttcagatagtacaaagaaacaaccatcagccggtaattagaccaaaaaagtgtgtggacaactacttggcaaatgaaatccttcgcacagagatgcgatcgagcagtcctgacatgtatgctaataatcctttgatggagtatctggactcttatggtatcatggatgctgaagatgaattagatgcttatgcacagtatactgagaacatagctgtgaaatctgctcgtcaatctgagagaaaagctaggagaactagagcagcaataaaagctagcacaaccctccatgcttcacaaaaggttgcattatcctcaaagaagaagcggtccaagggttcctcgtctagtatgaatcctttaggttcgttgtggaagatgaccggtaggagacttcttacagccaaggaagaggttgaattctcagaaggtattcaggatcttttgaagcttgaggcgatccaagctgagcttatagagtacaatggcggtcagccaaccttctcgcagtgggcaacagcagctggagttgatgagaaaactttgcgcaagcgcttgaattatggtatttattgcaagaacagaatggtaacatctaatgtgagacttgtaatctctattgccagagagtttgaaggccctggaatggacttttatgatcttattcaggaaggaatgcagggccttataaggggagctgaaaaatttgattcatcaaaaggttttaggttctctacgtattctcactggtggatcaaacaagcaatgcgtaaatctgtctcagagcaatcccaaatatttcgcttgcctgctcacatggttgaagcaagctaccgtgtaaaggagtgtacaaaacgacttcgccgtaagcttagaagacgacccaccaatgaagaaattgcagtggacactggtattccaattaaacgagttgaggcagcagtaaacctcccaaaatatagtgtgtcccttgatagcaaaattggttccaccgacatgacatatcaggaggtcacagctgatcccagtgctgagacagctgaagagatgctcaacagaatgtccatgaagaaggacgtacacatggcactagatactctcaccactcgcgagaagcaagttgttgttctgaggtttgggctcgaggatggtcggataagaaccctgcaggagatcggtaacatcatgggtgtgagcagggagagaatccggcagatcgagtctggcgcgttccggaaactaaggagcaagaagaaggtgaaggctttgaaggattatctggtgccagtaggcaattggtgaaccgtttgtttgcagaatttgttttccttttggttcctctttttttttttgaggattctgtacttgtaccattttacgtgggtcctcatgtaaaacacgctatcagaatacttgcatcacaagaggaaagagtagtttagttccgtggg

SEQ ID NO: 8941 - DNA, 1781 bp, Zea mays
ctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtcccgcgtggagcgctacggctccaccgtggtgcgcatgaacgtgccgccgggccccttcatggcgcgcgacccgcgggtggtggcggtcctggacgccaagagcttccccgtgctcttcgacatggacaaggtggagaagaaggacctgttcacgggcacctacatgccgtccacctccctcaccggcggctaccgcgtctgctcgtacctggacccctccgagcccacccacaccaaggtgaagcagctgctcttctccctcctgctctcccgcaaggacgacgtgatccccaccttccgctccaacttctcctcgctcctcgccaccgtggaggcggagctggccaagggcggcaaggccgagttcaacaagctcaacgacgtcacctccttcgacttcatcggcgaggcctacttcggcgtgcgcccctcggcgaccgagctcggcaagggcgggccgagcaaggcggccaagtggctcatctggcagctccacccgctggtcacgctcggcctccccatggtcctggaggagccgctgctccacacgttccacctcccgcctttcctcgtcaagggcgactacagggcgctgtacaagtacttctccacggtggcgaagcaggcgctggacaccgccgagggcctgggcctgtcgcgcgaggaggcctgccacaacctcctcttcgccaccaccttcaacagctacggcggcctcaaggtgctgttcccgggcctgctggccaacgtggccagcggcggcgagaagctccacgagcggctggtggccgagatccgcggcgccgtggccgacgccggcggcaaggtcaccctcgcggcggtggagaggatggagctggccaagtcggtggtgtgggagtcgctgcgcctggacccgcccgtcaagttccagtacgggcacgccaagaaggacctgctggtggagagccacgacgcggtgttccaggtgaggaagggcgagatgctgttcggctaccagccgtgcgccaccaaggacccccgcgtgttcggcgacaccgccggggacttcgtgcccgaccgcttcctcggcgaggagggcagcaagctgctgcagtacgtgtactggtccaacggccgtgagaccgagaaccccagcgtcgacaacaagcagtgccccgggaagaacttcgtggtgctggtcggcaggctcctcctcgtcgagctcttcctccgctacgacacattcaccgccgaggtcggcaaggagctgctcggcaccagcgtcatcttcaccggtgtcacgaaagctacctccggtccgggcagcgagtaaaccgcccggccggcgcgcgtcgttggatatatgatgagtggacgtgacagagtgtcccattatttcttaatttcgtcattttcctccttccttctaataagacttctctctcaccctcggccccaccttcacgtgtgattggaggtgtttgtcgcttttgtaataattataatgcaggatggcatgttgcataaattgctccccaaaaaaaaatcttatctttcacaag

SEQ ID NO: 8942 - DNA, 1704 bp, Zea mays
ccagactagcagatagagaggcggagccgcggaggccagcatatctccctcgttttggtttgcgcccaagcaagcgcctcacgcgagcaccgccgctgccgccgttcactttccccctgaacaccagccgccgccgccgccgccgccgtcgccgccgcatgcacgcacgctgcctctgcacgagcggcaagcggcgatccggcgatcctcgtcgatccccgccctaacgcgctgcggtggtccgtgcagacaagatgaagttcggcgccacatatgaggagtatctccgggcagagcgggacaaattcctagggcaatgctcccatgtagaatacaaacgcctcaaaaaggtattgaagaaatgtagagttggtcgctcactgcaagcagatggcacaaatggtgatgagcagcaggaggggagagacgaatcttcaaacatttgtgaatgcaactcatgcacattgtgtgatgagatgttctttacagaactcaacaaggaagcatcagaaatagcaggttgtttcagatctagagtacaacgtctcctccatcttcatgttccttcaggactacaacgctgtatatggcgttttaggcagtgtttcatagatgatcagcaaataatggttcaagaaggcagaatgcttctcaattatgtgaccatgaatgctattgctattcgcaaaattctcaagaaatatgacaagatacatggttctgtgagtggcagagatttcaagagcaagatgcaaactgagcatattgaactgttgcagtcaccttggctgatagagcttgctgctttccatcttaactgcgatgattcagatgctgatgaacctagagctggagagttcttcaagaatggattcttcaagaatttttcctgtgacctgagtggagcacagccactactaacaatgaccatttctgaaactctgaagtatgagtacagcctaacttgtccaatttgcttggacactttgttcaacccttatgcgcttagctgtgggcatctgttctgcaaagcctgtgcatgtggtgctgcttctgtctacatcttccagggtgtcaagtcggcacctccggaggccaagtgccctgtctgccgagcggttggtgtgtttgatcgtgctgtgcgtatgactgaactagaattgctcctcaagagaagggacaaagattactttctgcagagactgcgcgaagagcgaagtgtgatggtgaagcaggccaaagaatactgggactcacaggcaatgctatcgatggggatttgaaagctacaatgttcttaccagttcaattgttgtggctaattacatctgaaggttctctggctaattacatattttagttcctggcaagcgtcaatcaattaagttaactgcgctcacataacagaaattgacatagcagaagctgagcccatcgaagaagcaaacaaaatcagttgcattctatcattctccgcctgattcagatttggaagaatcgaacggatttaactaatttctttgttccttccgttctactacaagcttgaaatgacgaaactcatattgtatttacatatctactgattattgggttatttaccctatttactgattgttggtgtgttatttgcctgtaaaagtgaagtcaaatgttgtccagctgccctgaacctcttaagaccatctccaaagttcaaccccc

SEQ ID NO: 8943 - DNA, 1164 bp, Zea mays
gaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatc

SEQ ID NO: 8944 - DNA, 811 bp, Zea mays
gcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgc

SEQ ID NO: 8945 - DNA, 1536 bp, Zea mays
ctcagcttgtcgatccatctgttctgtgcgcctactcgtatcttaggatccatctgtatgttgtttacttgttttcctgattgaatcgcgcattggatgcctggtggttggccttgctcctagtcttttcatttacacgagctttcgacgaagccgcgtctggtctgtctgctccatcacaagagcacgcaaatgctgagttcccccaccccccaacaaacaattactagagtagctgcattggcggggaaattaaagcgctagaagctcagcagcaatggcggagcaggcgggcgccggaaggtactggtgccacatgtgcgccgcggccgttagccccgcggagggcgaggtggagatgaagtgcccgttctgccacagcggcttcctcgaggagatggagaccgcccgcggggccgcgaccgacgacggtgacggcgacggcgacggcgcggtggctcaggtgcaccccggcgccgaccgcccgagctccatctgggcgcacgctatcctcagcacggtcgacagctccgcccgtcgccgccgcaaccggcggcagcaggaggccgccagcgacgtctacgactggaacgaccccgagttctcgctgcgccggcggcgcgtcaccgcgttcctgcggctcctgcacgagctccgggaccgccagctgcagcggctggagtccgctgccggcgtcgccctcgaaggcgaccagctgaccccgttcggccggagcctcttcatcggcgcagctggcggcgagcatggcgtggcgctgggcgactacttcctcggccccagcctcgacgccttggtacagcagctcgccgagaacgatgcggcgcggcacggaacgccgccggccaagaaggaggccgtggaggcaatgccgaccgtggaaatcgccggcggcaacgatggcgacgacgcggccagctgcccggtctgcctggaggactacgcggccggcgagcgcgcccgcgagatgccctgcaggcacaggttccacggcaattgcatcgtgccgtggctcgagatgcacagctcctgccctgtctgccggttccagctgccggccaccgacgacaagagctcatgcagcggcggcgacggtggtttcgtcagtgtcgatgcggatcgtgaaggcagtgacaacggcgggggtgatggtagggcaagctctccgggcaacgccgagctagctgaagctgaagagagtggcaggcggttgccgccatccttgcagtggctcaacagcctgttctcgccgtcggcgcagtcctccggtagcggcggcagcagttcgcatcattgggagaactaagcaatattgccatggttgctgccgcttgaaagcttggcccgttggttggtcccaatgtacataggaaggagcaggagcatgccgggttggtgccatgtaaaaatctggagccttttttcagtttggctcatgttaatggtctctgatatgtatcatggctgtaaaaaagaacagaaatgggcaaatgtatgaacttgccgcgctcttgcgtg

SEQ ID NO: 8946 - DNA, 1790 bp, Zea mays
ctcagcgaccaccaagcagagcaagccagtgaggtctctcagagcgtagccagccagctacaatggcggggaacgcgctagccaactatgtccaggtctacgtcatgctcccgctggatgtcatcactgtcgacaacacgttcgagaaggaggacgagacgagggcgcagctgaagaagctgacggaggcgggcgccgacggggtcatgatcgacgtctggtgggggctggtggaagggaaggagccgggagtctacgactggagcgcctacaggcaggtgttcaagctggtgcaggaggccgggctgaagctgcaggccatcatgtcgtgccaccagtgcggcggcaacgtcggcgacgtcgtcaacatcccgatcccgcagtgggtgcgggacgtcggcaaaagcaaccccgacatcttctacaccaaccggagtgggctgacgaacatcgagtatctcacgcttggagtggacgaccagcctctcttccatgggagaactgccattcagctgtatgctgattacatgaagagcttcagggagaacatggcagacttcttggatgctggtgtcgttgtggacattgaggtgggacttggccctgctggcgagatgaggtacccatcgtatccccagagtcagggatgggtgttcccaggcgttggagaattcatatgctatgataagtacctgcaagcagacttcaaagcagcagcagaagaggctgggcatcctgagtgggatttgcctgatgatgctgggacgtacaatgacactcctgagaagacccagttcttcgcggataacggaacataccagaccgacaaggggaagttcttcctcacatggtactcaaacaaactgatcaagcacggtgataagatcttggacgaagcaaacaaggtcttcctgggatgcaaggtgcagctggcaatcaaagtctctggcatacactggtggtacaacgttccaaaccatgcagctgagctcactgccggatactacaacttagatgacagagatggctacagaaccatagcacacatgctcacaaggcatcgtgctagcatgaacttcacttgtgctgagatgagggacagtgaacagagttcagaggcgaaaagtgcacctgaggaactggttcaacaggtgctgagtgctggatggagagagggcctaaatttggcatgtgaaaatgcactcaaccgatatgatgcaacagcttacaacaccatcctcaggaatgcaagacctcaaggcatcaacaagaatggccctccagaacacaagttgcacggattcacctacctccgagtatctgatgaactgttccaggaacagaactacaccactttcaaaacttttgtcaggagaatgcatgctaacctggattataatccaaatgtcgatccagttgcaccattggaaagatcaaaggcagagataccaattgaagaaatcctagaagtagcacagccaaaattggagccatttcccttcgacaaggacaccgacctaccagtttaaacactccaatgatgcaaactacaggaagaatcacgagacacttaaaaaatcaagacaaatagtaagcctattgtcgagcagtagtctattaactaaataaaatgctgtgtggagcatattataatcgcatattgccctaataatattgtgttgttaaacctgaggcttgatggttatctgatgagttgtaataatagccttggtcttcctgttgtatgtatgtatttgagctaaggaataaaaattgtggctttgtgggtt

SEQ ID NO: 8947 - DNA, 658 bp, Zea mays
tacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcacttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctatctgctgcctacccccagcaatttcttccattcaaccaactgacagcattgaactctcctgcttatttacagcagcaacaactactaccattcagccagctagctggtgtgagccctgctaccttcttgacacaaccacagttgttgccgttctaccagcacgctgcgcctaacgctggcaccctcttacaactgcaacaattgctgccattcaaccaacttgctttgacaaacccagcagcattctaccaacaacccatcattggtggtgccctcttttagatttcttatgagttatagttcaataataaagttttttgtctgatgtttgtggcttcccagaaataag

SEQ ID NO: 8948 - DNA, 1529 bp, Zea mays
ggcgaaaaataaaaaaaaaacgaagcgaaagcgaggctgctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtgcattgcgatgcaagtatcgctttcccgcttcttgttgcagcaacatttgcacgtaaggttcataaccccaaatgaacagactgaatgggattcagtggagtgaatgggcaacagaattttgttgaactctccaaatgacctttttggagcacgaggtctacttcacctgcacagggatcatgtgcaagtttttttcggtgactcgcggcaaccacatgccataattcttcgatgttcacttgatgctgtactagctggttgatagcatttttgttacaacagataatttattgaaatacagacatacgattgttcatccgagtcgtctgcttacgaattttttgtagacgaaacatctgcttacgaaattaacaaatggcctgttttatgaac

SEQ ID NO: 8949 - DNA, 1264 bp, Zea mays
tagcaatgtcggggatggcggcgcgcatcggcgagtggaagccggtgatggcgatgctcatcttcgacctcatctccgccgtgacgacggccctgatcaagaaggcgctgcaggaggggctggaccgcctggtgctcatcacgctgcggcagctcgtggccaccgtcttcctcgcgccgatcgcctacttcagagagcggagcacgaggcctaagctgacactggagatcctagtctacctcttcttcagcgcagcgtttggcgccgctctctcccagtacaccttcttctacgggctgcagtacaccaccgcgacgttcgccataactttcaccaacgtggctcctgtgctcactttcctcattgcagtcttgctaagggtggagtcactgagcatgaagaacaaggcaggagcagcgaagatcgccgggacgctgacgtcgttcgccggcgtcatgctcctcaccctctacaagggcgtctcactgacgcaccagcaagctggagaagcgagcccggaggatcacaacctcggagcagcagcagcatcgccgtctgacaggaagagctggacgctgggcaccctggcattgctcgccaactgcctgtgcttctccttctggctcctgctgcagtccaggctgaccaagaagtacccggcgctctactccagcacggcctacatgttcctcatcagctcgatgcagggaggggccctcacggcggccattcagaggcgagcgtcggtgtggcttctcacaaggccgatagagatcgtcacggtcttatatacaggaatcatggggtccggagtgggctacgtgctgatgacgtggtgcgtggagaagcgagggccggtgttcacgtcagccttcatccctgtcatccagatcatggtcgccatggtcgacttcttctttctccatgagaatctctatctcgggagtgttctgggatccatactcttgatcctgggcctctatattctgctgtggggaaagaagagggatgcctcatcatcagcggctgccaaggaagaggaagatggagagaaagaagatgaggaggaggaggacaaagagaagcaagtcagatcatgaggaccagaccactctcatatatatatatggattaggaccaaattaaagatacagttcttcggactgtgtgatgatctatacttgacagagatatatatatatatagtatttgtttaatatataactctgctagtatatatagtatttgttctgaattcaaaatc

SEQ ID NO: 8950 - DNA, 995 bp, Zea mays
gcggtttctctccctcccttgccttcgtctccgcctcccgtctttcctcaagaagtcgattcccttccccaagaacccaagcccccaccatgacaagctcctcctctccttcccgaaaggcgctgagcaagatcgcttgcaatcggctgcagaaggaactcgccgagtggcaactcagcccccctgctggattcaagcacaaggtctccgataacctacaaaggtgggtaattgaggtcactggagcggcgggcaccctttacgccggcgagacctaccagttgcaggttgacttccctgagcattatcctatggaggcacctcaggtcatttttctcaatccagcgccaatgcatccacacatctacagcaacgggcacatctgcttagatattttgtatgactcgtggtctccagcgatgaccgtgagctctgtctgtatcagtatcctgtctatgttgtctagttcgccagcaaagcaacgtccagtggacaatgaccgctatgtcaggaactgccgcaacgggaggtcgccgaaggagaccagatggtggttccatgacgacacggtgtaattgagcgcctgtcagccttccttgctgtggtatatctcgtcaaggggagattggggatgatttaggcctatttgtaagcatccctctatcggattgcgaagcttaccttcctgtggcggtgtgttaaatgagttgcacacatgtgtcgagtctgagaatacatattaccatcatcaatgatataagtaatatagaataagcatgagtgtaccctgcctgaatcactggaacgagctcaaaaggaattaactgtgcaggtttaactatgacttgctttgctcaatgtgcctttgtatcagtctgcagtctgcttatggatttgcctggttgttcattgtagcgctgcgctgctgctattgtgatagttgtaactcgcactgacaccgatggatttggtattccagttttctttctctgctg

SEQ ID NO: 8951 - DNA, 1315 bp, Cuphea pulcherrima
cgagcacgaggaaggaaaaaacatgcggatggagtctctgcttctgaattctttctctccatctccggcgggaggaaaaatttgtagggccgatacttacaagaaggcctacttcgcaactgcgaggtgcaacacattgaacagcctcaacaagaatacaggtgaatatcatctcagcagaacccgacaacggttcacatttcaccaaaatggtcacagaacttacctagtcaaggcagtgtccgggcagtccctggagtctgagcccgaaagttaccctaacaataggtgggattatgtcaaaagtgctgctgatgccttctaccggttttctcgtccccacacaattataggcactgcgttgagcatagtatcggtttcgcttcttgctgtagagaagttgcctgaattgaattcaatgtttttcactggcttattggaggtgattttggctgccctcttcatgaatatatatattgtcggtttgaatcagttgtctgatatagacattgacaaggtaaacaagccgtatcttcccctggcatcaggagaattctcggttggaactggggttaccattgtaacatccttcttgattatgagcttttggctggggtgggttgtcggttcatggcccttgttttgggcccttttcatcagttttgtgcttggaacagcatactcaatcgatatgccaatgctcagatggaagagatctgcagttgtggctgcactgtgcattctagctgttcgggccgtgattgttcagatagcgttttttttgcacatgcagatgcatgtgtatggaagagcagctgcactttctcggcctgtaatatttgccacaggctttatgagcttcttttctattgttattgcgttgtttaaggacattcctgacatagaaggtgataaaatatttgggatccggtcattcactgttcgtctgggccaagaacgggttttctggatatgcatatcacttctcgaaatggcttatgctgttgcgattcttgttgggtcgacgtctccctatctttggagcaaagtcatcacggtttcgggtcatgttgtgttggcctccatactatggggacgagccaagtctatcgactttaagagcaaagcagcactaacctccttctacatgtttatttggaagctattttacgcagaatacttgcttataccgcttgtacgatgagctttcgggatcagaacattacattatcgtaaactgaacaatttagaattgcatattgttcagatgacagctccatcttggcaataaaatttgatatgaatgtctctgatc

SEQ ID NO: 8952 - DNA, 1333 bp, Cuphea pulcherrima
ctggtttgtgggttttgcgagcacgaggaaggaaaaaacatgcggatggagtctctgcttctgaattctttctctccatctccggcgggaggaaaaatttgtagggccgatacttacaagaaggcctacttcgcaactgcgaggtgcaacacattgaacagcctcaacaagaatacaggtgaatatcatctcagcagaacccgacaacggttcacatttcaccaaaatggtcacagaacttacctagtcaaggcagtgtccgggcagtccctggagtctgagcccgaaagttaccctaacaataggtgggattatgtcaaaagtgctgctgatgccttctaccggttttctcgtccccacacaattataggcactgcgttgagcatagtatcggtttcgcttcttgctgtagagaagttgcctgaattgaattcaatgtttttcactggcttattggaggtgattttggctgccctcttcatgaatatatatattgtcggtttgaatcagttgtctgatatagacattgacaaggtaaacaagccgtatcttcccctggcatcaggagaattctcggttggaactggggttaccattgtaacatccttcttgattatgagcttttggctggggtgggttgtcggttcatggcccttgttttgggcccttttcatcagttttgtgcttggaacagcatactcaatcgatatgccaatgctcagatggaagagatctgcagttgtggctgcactgtgcattctagctgttcgggccgtgattgttcagatagcgttttttttgcacatgcagatgcatgtgtatggaagagcagctgcactttctcggcctgtaatatttgccacaggctttatgagcttcttttctattgttattgcgttgtttaaggacattcctgacatagaaggtgataaaatatttgggatccggtcattcactgttcgtctgggccaagaacgggttttctggatatgcatatcacttctcgaaatggcttatgctgttgcgattcttgttgggtcgacgtctccctatctttggagcaaagtcatcacggtttcgggtcatgttgtgttggcctccatactatggggacgagccaagtctatcgactttaagagcaaagcagcactaacctccttctacatgtttatttggaagctattttacgcagaatacttgcttataccgcttgtacgatgagctttcgggatcagaacattacattatcgtaaactgaacaatttagaattgcatattgttcagatgacagctccatcttggcaataaaatttgatatgaatgtctctgatcc

SEQ ID NO: 8953 - DNA, 1331 bp, Zea mays
gctactgccggcgttccagagttcgagctgagcagttgcacacagctgctcgtgaagctagctagcgaagccacaggcccccagtgactttgctcccccacaccgtagcggccgtataaaccagctccaaccgatccatcgaaatcgaaccacagtacgtgagcccgtactagagacatatggcctccgcgatcaaggctgcatcgacctcctcccggtggtcttcgtccccggcggcagtccactgtaagggcggtcgccgcggtagctccggctgccccggcggcgccggccaagctcaccgccggtgccggcggccgatgcctgccggtgtcgcagaccatgtccaggctcagggcgcagggcaagacggcgttcatcccgtacatcaccgccggcgacccggacctggcgacgacggcggaggcgctgcggctcctggacgcctgcggcgccgacgtcatcgagctcggcgttcccttctcggacccctacgccgacgggccggtcatccaggcgtcggcggcgcgggcgctggcgagcggcacgacgccggacggcgtgctggcgatgctgaaggaggtgacgccggagctgtcctgccccgtggtgctcttctcctacttcaaccccatcgtgcggtggggcctggccgacttcgccgccgccgtcaaggaagccggcgtgcacggcctcatagttcccgacctcccgtatgggaactcgtgcgctctcactctcaggaccgaagccatcaagaacaacctcgagctggtgctgctcacaacaccatctacgccagcggacaggatggaggagataacacgagcttcacgaggattcgtctatctcgcgagcgtcaatggagttacaggtccacgcgcaaacgtgaacacacgtgtccagtctctcattcaggaggttaaacaggtcactgacatacccgtggctgtcgggtttggcatatcgaaacctgagcatgtaaagcagattgcagagtggggtgcagatggtgtgatcattggtagcgcaatggtgagacagttaggcgaagcagcctctcccaaagaaggattgaagaggctagagaaatacgccaggatcatgaagaacgcgctaccatgccagtgaactagtcgtattgacgcgatataggctgtgttagcaagcacgttggagaacaatgttgcagaagtagcacaattaataatgatccattcggcaaggttgcttttttacaaattgcaacaatatgttatcaatataaaatcaacgattcctttgtttaaaaaaaggaagaaatgttacatcattgcatgatgcttcgattc

SEQ ID NO: 8954 - DNA, 1820 bp, Zea mays
gctcatcctctcgcaccgcaccgttcgcttcctttcgtcaactccactcctcttggccgccgcattacctcctcttcgccgctgccgccaccgctccaccgggcagccagccagccatggatgaggagtacgacgtgatcgtgcttggcacggggctcaaggagtgcatcctcagtggtctcctttccgtcgacggcctcaaggttttgcatatggacagaaacgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacactgatgtgacaaagtacttgtcattcaaagctgttgatgggagctatgttttcagcaaagggaagatttacaaggtccctgccactgatatggaggctctgaagtcccctttgatgggtctattcgagaagcgcagagcaaggaacttcttcatttatgtccaagattacaatgaagctgatccaaggacacatcaaggattagaccttactagggtgacaactagagaacttatagcaaaatatggtttaagtgatgatacagtggatttcattggacatgcacttgctcttcatagagatgatcgctatcttgatgaaccggcacttgatacagtgaaaaggatgaaactatattcagagtctcttgcgcgctttcaaggaggctcgccatatatctatccattgtatggtctgggtgagctaccacagggttttgcacgattgagtgctgtttatggtggtacttacatgttaaacaagccagagtgcaaggttgaattcgatatggaggggaaagtgtgtggtgtcacatctgaaggtgaaactgcaaagtgcaagaaggtggtctgtgatccttcgtatttaccaaacaaggttaggaagattggtagagttgttcgtgcaattgctatcatgagccacccaatccctaatacaaatgagtcccactcggttcaaattattttgcctcagaaacaacttggacgtagatcagacatgtatgttttctgttgttcatacacgcacaatgttgcgccaagagggaagttcattgcatttgtgtctgcagaagcagagactgataacccgcaatctgagctaaagcctggaattgatctacttggttctgtggatgagatattatatgatatttatgacagatatgaaccagtgaatgaaccatctcttgataattgctttgtcacaacgagctatgacgccaccacacattttgagacaactgtaacagatgtcctgaacatgtatacaatgatcactggaaagactgtggatcttagtgtggatttgagtgcagctagtgctgctgaagaatactgatttcagtcataatgtttatcaaagatcacatcattggggacagcacatgaccaaacttcaatgagtggctagtatgagtttagtcggttccagattataccatgccgacttctactgtacctcgtgaatcgtgatgtctattgggcacttgttgctgacagaactgtgcacaatgttgatccaatttgatggatggtggtggttctgttatttactagtcggtcaaaacactaaacggtggccatcatggctgtgtgatgtatcataactgttcagtaaatttgtgttcttctgcccggagttctgctcgatgctattgcgggcggcccgaggtgcttgctctactgtgaatgaatgaagtttgtc

SEQ ID NO: 8955 - DNA, 779 bp, Zea mays
accaacaatggcagccaaaatattttgcctccttatgctccttggtctttctgcaagtgctgctacggcgaccattttcccgcaatgctcacaagctcctatagcttcccttcttcccccatacctctcaccagtggtgtcttcggtatgtgaaaacccaattcttcaaccccacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacatcagtttcttccattcaaccaactagctgcattgaactctgtttcttatttgcaacaacaacaactaccattcaaccagctagctgctgcctacccccagcagtttcttccattcaaccaactggcagcattgaactctcctgcttatttacagcggcaacaactactaccatttagccagctagctggtgtgagccctgctgccttcttgacacaaccacagttgttgccgttctaccagcacgctgcgcctaacgctggcaccctcttacaactgcaacaattgttgccattcaaccaacttgctttgacaaacccagcagtgttataccaacaacccatcattggtggtgccctcttttagatttcttatgagttacagttcaataataaagttttttgtttgatgtttgtggcttcccagaaataag

SEQ ID NO: 8956 - DNA, 1468 bp, Allium porrum
gcacgagttttgaagaatgttaagcatggactccctccttaccaagccagttgtaatacctctgccttctccagtttgttcactaccaatcttgcgaggcagttctgcaccagggcagtattcatgtagaaactacaatccaataagaattcaaaggtgcctcgtaaattatgaacatgtgaaaccaaggtttacaacatgtagtaggtctcaaaaacttggtcatgtaaaagccacatccgagcattctttagaatctggatccgaaggatacactcctagaagcatatgggaagccgtactagcttcactgaatgttctatacaaattttcacgacctcacacaataataggaacagcaatgggcataatgtcagtttctttgcttgttgtcgagagcctatccgatatttctcctctgttttttgtgggattattagaggctgtggttgctgcattgtttatgaatgtttacattgtaggtctgaatcaattatttgacatagaaatagacaaggtcaataaacctgatcttcctcttgcatctggagaatactcaccaagagctggtactgctattgtcattgcttcagccatcatgagctttggcattggatggttagttggctcttggccattattctgggcgctttttattagtttcgttcttggcactgcatattcaatcaatctaccatttctaagatggaagagatccgccgttgttgcagcaatatgtatccttgctgtacgagcagttatagtccagctcgcctttttcttacacatacagagttttgttttcaaaagaccagcaagtttcacaaggccattgatatttgcaactgccttcatgagcttcttctcagttgttattgctctatttaaggatatacctgatatagacggagacaaaatatttggcatccattctttcagcgtgcgccttggccaggagagggtgttttggatatgtatatatctccttgagatggcctacactgttgtcatggttgttggagctacttcctcatgcctatggagcaaatgcttaacagtgataggtcatgcaattcttgggtcgttactttggaatcgtgctagatctcatggaccaatgaccaaaaccactattacatctttttatatgttcgtgtggaagctcttctatgctgagtacttgctcattccttttgtaagatgagggtttatgacctacatggaaaagaatcgcaagagaagatgagtagataatggaggcagaaatggctggaattaacaacgctttaattgtcatcttaaaaacggagagttctttcaacaattgcagatcatttctccttaattatattcatgttgtatgttgtgttaaagattatcattgaatgacaatagcctatgttgaatttaggatatccagtggttttctttgttcttttttaagaatttattcacagaaaaatgaagt

SEQ ID NO: 8957 - DNA, 1885 bp, Allium porrum
gggccccccctcgtgccgcaatcaatttctttctcatttcatcaattctatttatttcctctccgtgttttgctttccgaaagagaatccgttataaaccgtgctccgaaaccaaatctcactttctagataatgggggcgtattccgttgcatcgcctctctgcacgtggctcgtcgctgcatgcatgtcagtcacgtgcaatggagaacgctccttgagatctccgtcgtcacttgcttttgctccttctaagaggagtcggtcgaataagttggtgaaaagaaggggatccaacggtcaggattcgtttggtcttgtttctgcgttttgtggatcgggaattcatttcgatagtctgattagttctctagagccatgtgaagagttctacagatcattaagttttgttagtgatccaaagaagagaagagctgacaaagtgatggcagtagctgtgcaacctgcaaagcaagtagaagagaagaaaatgactgctactaaacagagacgggttgtggtgacagggatgggcgttgtgactccattaggccatgagcccgatgttttctataataatcttcttgaaggagttagtggcattagcgagatagaaaattttgactgtaaagaatacccaacgagaattgcaggagagatcaaatcattttcaacggacggatgggtagcaccaaaattatcaaagaggatggacaaattcatgctttacatgcttactgcaggcaaaaaagctcttgcagatgctggtattagtgaagaaattctgtgtgagctggacaagacgaagtgtggtgttcttatcggttctgctatgggtggaatgaaggttttcaatgatgcaattgaagctttgcgtgtgtcatacaagaaaatgaatcccttctgcgtaccatttgccaccacaaatatgggctctgccatgctcgctatggatttggggtggatgggtccaaactattcaatctcaactgcttgtgctactagcaatttttgtattctaaatgctgctaatcatatcataagaggcgaagccgatctaatgctctgtggtggctctgatgcggcaatcatacctattggattgggaggttttgtcgcttgtagggcactttcggaaagaaacagtgacccgaccaaagcttcacgtccatgggatagcgaccgtgatggatttgttatgggagaaggtgctggtgtactacttttagaagagctggagcatgctaagcaaagaggagcaaagatttatgcagagttccttggaggcagtttcacatgcgatgcttaccatcttacagagccacaccctgagggaacgggtgtctcgctttgcattgaaaatgcgctcgtggaatcaggagtagcaagagaagatgttaactacataaatgctcatgctacttcaactcctgctggcgatgtaaaagaataccaagctcttattaattcttttggcaataatcctaagctgagggtaaattcaacaaaatccatgattggccatcttttgggagcttctggagcagtggaagctgtagctgccatccaggcaattagaactgggtgggtgcatccaaatatcaacttggaaaatcctgaccgaagtgtggataccaaatttcttgtgggttccaagaaagaaaggctggatgtgaaggttgcactatcaaattcatttggttttggaggccacaattcctcaattctctttggccgttacgagcagtgatcgaaaaattttcatgtattctatgttcttttattttgattggttttgttaggatatataagaaatatattccagtcaaggttctatcctgtgtaaagacattacacttctacacccatgaaagcaccaagccttc

SEQ ID NO: 8958 - DNA, 1248 bp, Gossypium hirsutum
agggagtggcagtggaagatggccgctagcagcgatcctaacccggagggttccgatgagcagcagaaacgatccgagatatacacttacgaggccccttggcatatctacgccatgaactggagtgtccgccgcgacaagaaataccgtctcgccatcgccagcttgctcgagcattacaacaaccgccttgagattgtccagctcgatgactccaatggcgagatccgatcggacccaaatctctccttcgatcatccttatcccccgaccaagaccatcttcatccccgacaaggagtgccagaaacccgaccttctcgccacgtcctccgacttcctccgcatttggcgcatctccgatgaccactcccgcgtcgacctcaagtctctccttaatggcaataagaacagtgaattctgcggtcctcttacctccttcgactggaatgaggcggagcccaagcgaatcggcacctcctccattgatacgacttgtactatatgggatatcgagagggagacggtggatacccagcttatcgcccacgataaggaggtttatgatattgcctggggcggcgtcggtgtttttgcttccgtctctgctgatgggtccgttagggttttcgacctgcgcgacaaggagcactccactatcatttatgaaagttcggagcccgatactccgcttgtacggttggggtggaacaagcaggacccgagatatatggctactataattatggacagtgctaaggttgttgttttggatatccgcttcccgacactgccggtagttgagctgcagaggcaccaggctagcgtcaatgccatcgcatgggcaccccacagctcttgccacatttgcaccgccggggatgattcccaggccttgatttgggacttgtcctccatgagtcagcctgtggagggtgggcttgaccccatccttgcctacaccgctggggctgaaatcgagcagttacagtggtcatcttcccagcctgattgggttgccatcgccttctccaccaagcttcagattctcagggtatgagtgaatgggattggtatattgggtcgtattcaatgctaaattgctaattcatagtctagtaattgtactcagatctagaggaataacaagattgttgctgtcgttgtgtctgagctgactaaaagtcccaaaactgttttggttttcctgttgtttcgtttgtcttcaacatgtttggatagttgattg

SEQ ID NO: 8959 - DNA, 1554 bp, Zea mays
ctccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggaggtttccccgggggtggcatgcctgggggtttccctgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaccaaacggctctatggtgatgtatgcaaaaagttgctttcgaacttgatttctcaattcacagatggtttgacagtttcttgaattatagaatgcttgtgtgctgctagtttccct

SEQ ID NO: 8960 - DNA, 1137 bp, Zea mays
gccactgagccactcaacgtcgagatcgagacgacccgagtccgccgcgcccgtgcaccaccgaccgtcgaactcccgaaagtaactctatttcttgatcaacatcaacatgtcgcgggaggataatgtttacatggccaagctggctgagcaagcagaacgatacgaggaaatggttgagtacatggagaaggtggctaagactgtagatgtggaagagctcaccgttgaggagcggaacctcttatctgttgcctacaagaacgtaattggggcccgccgtgcctcatggcgcattatctcctccatcgagcataaggaggagtcccgtaagaatgaggaacatgttattcagatcaaggagtaccgtggcaagattgaggctgaattgagcaacatttgtgatggtatcctgaagttgatcgactctcaccttgtgccttcctccactgctgcagagtcgaaggtgttttacctcaagatgaagggagattatcacaggtaccttgctgagtttaagactggtgctgagaggaaggaagctgcagagagtacaatgatagcttataaggcagctcaggatattgcgttggcggaactggcatctactcatcccataagacttggacttgcacttaacttctcagttttctattacgagattctgaactctccagacaaagcttgcaaccttgccaggcaggcgtttgatgaggctatttctcagttggatacgcttggcgaggattcatacaaagatagcaccttaatcatgcagctcctgagggacaacttaaccctatggaccgctgacagcacaacggaggacggcatcgaggagggcaatgaggcctcgaagggtgatgctggtgagggtcagtagtctggtaaaacctcgattgatggttcggcatgtttttgaagtccactgtgttggaaaccatgttctaatagaaggcgtctcccgctccatgcattccaagattctgtcctccccctccctcacccatgttgtaggctggtagtggtcaaattagttggccctgggtccaattggactgatgtattgtttactgctattgaagtcattcgttctcgttttgcttttgcagtggatcgctgtagccttgtgttttc

SEQ ID NO: 8961 - DNA, 764 bp, Zea mays
ctccggtctgcgctcccacagcctcacccctgcgcccccgccgattcgcgtcgccctttgttggaaggaacgatggagcagaccttcatcatgatcaagcccgacggcgtccagcggggcctgatcggggacatcatcagtcgcttcgagaagaaagggttctacctcaaggggatgaagttcatgaacgtggagaggtccttcgcgcagcagcactacgctgacctttccgacaagcctttcttccccgggttggtggagtacatcatttccggccccgtggtggcgatggtgtgggaggggaaggacgtcgtgttgactggccgcaggatcattggggccaccaggccttgggaggcagcccccggtaccattcgtggggactacgccgtggaagtcggcaggaatgtcatccatggaagcgactccgtggagaacgggaagaaggagatcgctctctggttccctgaaggtgtggcacagtggaagagcaaccttcatccctggatctacgaggcttgagcagttgagcttggatgccttgcctgcttccatggaaaccagagttttgtttgagtattatctgttggctctggctgaagagtcataatttagcgctctgtgtgttacaccagagttaagtctgcctgaacttatgtggcatttgtttgagtttctaccttcgtgccctgttttctaatgtaccgtggttgtgaaccggtcaatgtgatctgaaataaaacattgcgtgccaagtttgtgtt

SEQ ID NO: 8962 - DNA, 930 bp, Triticum aestivum
actcctccgccgcgagacatggccggcacgggcgacgacgccgggatggacgaggtccagaggcgcctcatgttcgacgacgaatgcattttggtagatgaacaggacaacgttgtcggccatgaatcaaaatatacctgccatctgatggagaagattgaatctgagaacctgctccacagggcattcagcgtattccttttcaactcaaaacatgagctgctacttcagcaaagatctgcgacgaaggttacgtttcctttagtatggaccaacacctgctgcagccatcctctgtaccgtgaatctgagcttattcaggaaaactttcttggtgtcagaaatgctgctcagaggaagctcctcgatgagctgggcatcccagctgaagatgtgcccgttgaccagttcacccctctcggtcggatgctttacaaggcaccatctgatgggaaatggggcgaacatgagctggactacctgctgttcatcgtgcgcgaggtgaagctggtcccgaacccggacgaagtggccgacgtgaagtacgtgagccgggagcagctgcgggagctcatccagcaggcggacgccggcgagggcggcgtgaagctgtccccttggttcaggctggtggtggacaactttctcatgggctggtgggagcacttggagaaaggcacgctcgcggaggccgtggacatggaaaccatccacaagctcaagtgaggacgccatctcttgatagttgttgttgtgtgctgaaaaagaacttatccacaggcagctagataaaccgtcgcatctcatctggataataaaagaacagttgttacctggcctgatgatggccactttgtattggttattacctcacatattcacctgtaccataacgacgatgatgataaaatgataatggtggcataattc

SEQ ID NO: 8963 - DNA, 1442 bp, Zea mays
gccggtgtcgtggccatggagctcggagtcggagatgtgctggggctgcagcaaggcatcgcaatcaccgcgccatcgcccagggacagcgacctgggtcttctcaagcgagcaggcctcacccaggctgcggctgctgccccctacccctcccccttccttgacgaggagaagatgctcaggttctccaaggcggctcacacattgcactcaggcttggattttggaggcccaggtgagcaggctttcctgctgtccaggaccaagatgccatttactccctcgcagtggatggagctggagcaccaggctctgatatacaagtacctcaatgcaaaggcccccccataccttccagcctgctcatttcaatcagcaagagcttcagatcatccaatagagtgagctggaggcctctgtatcaaggctacacaaatgcagactctgacccagaacctgggagatgccgacgaacggatggaaagaagtggcggtgctccaaggaagcaatggctgatcacaagtactgtgagcggcacatcaacagaaaccgtcaccgttcaagaaagcctgtggaaaatcaacctaagaagaccaccaaggaggtgcctgctgctgctggctcattgccatgtgctgggccacaaggtagcttgaagaaggcaaaagttaatgactccaagccaggcactgtcagctattgggcagatagtttaaacaggacaatgttgagcagagagaaagcaaacaaaccgacggaagatagctctttgctgcttacttctacgaacagccaacccaccttgtccctgctctctcagctgaagcagcaaaacaaaccagataagttaggccccacactggaaaatgagtcaaacccagacacaatattgaaagcctggggtggcaaccagcctagccacaagagcatttcctctacagagcgccatgatgctgaatccctccaatcagtccttcaaaatttcagcctagcccagaatgagaagatggagtcagaaaagaacaaatattctgattccgtgctagtttcgtcgactttctattctgcagacggtccaagagctacctgccttacacctaacatgacacaggtgaagcaggattgcatatcaagctcttgggagatgcctcaaggtggacctctaggcgaaatcttaacgaactccaagaatagcaaggacttaagcaagtgtaaaccaaggtcatatggttggttgttgaatcttgaccatgcaccatgattcctcaatccatgaagagcttgacatagatatcccatcatgtaggcaaacaatggtcagaaaaaggttatgaccacattgcttgccccatgcatgcttgctatctacatttgtatttctgttacgtagcatttagctagttgaattatcagttcttctggatacggctgtatcttaaac

SEQ ID NO: 8964 - DNA, 781 bp, Zea mays
gttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 8965 - DNA, 1604 bp, Zea mays
cccctcgacagaagcccccaaatccgataccttcccctatccacctcgagtcccttccttccttagcggcggcgcgaaggcggcggagccatgggcggagtcggcgaaggtgacgcgtgggcggatcaggagcagggcaacggcgggggcagccgtggtgttggcggtggcggcggcgaggcgaagcggtcggagatctacacgtacgaggccgcctggcacatctacgcgatgaactggagcgtgcggcgcgataagaaataccgccttgccatcgccagccttctcgagcaggtcaccaaccgcgtcgaggtcgtccagctcgatgaggcctcgggtgacatcgcccccgtcctcaccttcgaccatcagtacccgcccaccaagaccatgttcatgccggacccgcacgcgctccgccccgacctgctcgccacctccgccgaccacctgcgcatctggcgcatcccgtcctccgacgacgccgaggacggcgccgcctccgccaacaacaacaacggctccgtccgctgcaacggcacccagcagccgggcatcgagctacgctccgagctcaacggcaaccgcaacagcgactactgcgggccgctcacctccttcgactggaacgacgccgatccgcgccgcatcggtacctcctccatcgacaccacctgcacaatctgggacgtcgagcgcgaggccgttgacacccagctcatcgcccacgacaaggaggtctacgacatcgcctggggcggcgcgggggtctttgcctccgtctccgccgacggctctgttcgcgtctttgatttacgggacaaggagcactccacaatcatttatgagtctggttcaggtggcagcagcggcggcggttccaactctggcgccggagatggtgggactgcgtccccgacaccactcgtgaggttgggctggaacaagcaggacccaaggtacatggccaccatcatcatggacagccccaaggtggttgtgcttgatatccgctacccaacactgccagtggtagagctacaccgtcaccatgcccctgtcaatgccattgcgtgggcacctcactcttcttgccacatctgcacagctggggatgacatgcaggcactgatatgggatttgtcgtctatgggaactggtagcaatggcagtggcaatgggaatggtaacacagccgctggagcagcagcagagggcggtcttgatcccattttggcatatacagcaggggcagagattgagcagttgcagtggtcggcgacccagcctgactgggttgcaatcgcattcgccaataagcttcagattctcagggtctgatttcctagttccaccctgtttcagtgaggagtaaaaaatgctaaacttggataatgagctgatgcccggaggataatcttgcaattgctttactgttgcttatttatgttgtggacaactgatattcatggcgggttagttctagaaatagaacagaagactttctagttagaagctgaattgtcaatgaatttggtttgtagagtaaggaactgctctggtgttagcgatggtgataatgggaactgaatttagtttgttct

SEQ ID NO: 8966 - DNA, 1604 bp, Zea mays
caagcacactgctcctccctccccagccgcagcacagcagagcagagccgagtttgctgctgctgacctgacaccatcgtgtgcccctctctcggtccagaaggacgcgaaccgcgctcgtagagtgtggcagcaatggcggtcgtcgccggagacagcgagtcgctgatgcagcggtgcaagccgtacgtggcgatgatctcgctgcagttcgggtacgccggcatgaacgtcatcaccaaggtgtcgctcaaccacggcatgagccactacgtgctcgtcgtctaccgccacgccttcgccacgctctccatcgcgcccttcgcgctcgtgctcgagcgcaaggtccgccccaggatgacgctctgggccttcctccagatcttcgtcctcgcgctgctcgggccggtgatcgaccagaacttctactacgcggggctcaagttcacctcgccgaccttctcctgcgccatgagcaacatgctccccgccatgaccttcgtcctggccgtgctcttcaggatggagaaggtgaacctgaagaaggcgaggtgcgtggccaaggtggtaggaacgctcgtgacggtggccggcgccatgctcatgacgctctacaagggccgcgtcgtcgagttggtctggaccaagcacatacacctccacggcccgcacccggacgccgccgctgctgccgccgccgccgacaaggactggttcaccggctccattttcctcatcatcgctaccctcgcctgggcgtccctcttcatcctccaggccgccacgctgaagaggtacgacgcgccgctgtcgctgaccaccctcatctgcttcgtgggcaccctgcaggccatcgtcgtcaccttcgtcatggagcgcgagccctccgtgtggaggatcggcttcgacatgaacctcctagccgccgcctacgctggcatagtgacgtccagcattgcctactacgtgcaagggctggtgatccagagccggggccctgtcttcgcctccgccttcagccccctcatgatgatcatcgtcgccatcatgggctccttcatcctcgcagagaacatctacctcggcgggatcatcgggtccgtgctgattgtcgccggcctgtactcggtgctgtggggtaagcacaaagagaacgaggagaaggagggagaggcggccatggagatccccgtggcgatcaaggccgtcgacggcaatggcaggatcatggagatcgtggagctggacgaggtgcagctggagaaagcccaggccaacaccaacgccaacgccaacgcggccgtcgccgtcacggcggtccccgcggcggaggcccggatgcagggcaaggacgaccaggcttaagctacaggagatgcgccgatcgacgggtcgatcgcgcgcgtgcgtcatcttagccctcctgtgctgtgcttttgtgcgtcctcttctcccccggccggcccatgatagatgtgttgtagtgtggggcgacctgatgctttaagctagcgacgggcagtagtagtgctagctgtagtagtgaagtggtgccaagatggaagctgaggaggatgcaatataatgatgatggggagttttgt

SEQ ID NO: 8967 - DNA, 1304 bp, Zea mays
cgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggacgagctctcggtggaggagcgcaacctgctgtccgtcgcctacaagaacgtcatcggcgcccgcagggcctcgtggcggatcatctcctccatcgagcagaaggaggaaggccgcgggaacgaggcgcacgccgcatccatccgcgcctaccgctccaagatcgaggccgagcttgcccgcatctgcgacggcatcctcgcgctcctcgactcccacctcgtcccatccgccggcggcgccgagtccaaggtcttctacctcaagatgaagggtgactaccacaggtaccttgctgagttcaagtcaggtgcagagaggaaggatgctgcggagagcaccatgaatgcctacaaagctgctcaggatattgctcttgctgatctggccccaacccaccccatcaggctcgggcttgctctcaacttctcagtgttctactacgagatcctcaactcccctgaccgtgcttgcaaccttgcaaagcaggcctttgatgaggcaatctccgaactagacagcctgggagaggagtcctacaaggacagcactctgatcatgcagctcctgcgtgacaacttgaccctatggacttccgacaccaacgaggacgccggagatgagatcaaggaagcagctgctgcccccaaagaatccgcccccgagggccagtaagacggatccgatctcccgacctgatgcgtgtctgctgatgtcggggagtttaccaggactgtgccgttcttgatttctgatagcttatcttctagtacacctcgtgttgttctcttcgtcacggcgccggtgcgtgtgcgctgaagctgcctgccattgccattgccgctgtttttaattaagcacacactctagatgttatgcccgcatgctatgtttcgattctcaaagttgataaatgatggctggatgctggttttcgtgctccaagcctgctgcttcttccagggaaaaaaagacctgcccttgttgcagcgttgttgtttagaatgacctatatttgactggtattctgttacggtggctttgcaaagctgtttgtttggtttag

SEQ ID NO: 8968 - DNA, 1092 bp, Zea mays
cgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattagtttgctttgtgttgccgctagtccatgtggactggtattgttcccctggatttatttggcaagcgtgtccgtgctcgctctagcgttttattgagctttt

SEQ ID NO: 8969 - DNA, 1895 bp, Zea mays
cccagagcgaggaggtggaggacggacgggaggaggagaggagagagcccaccacccgcgaccgcgaccgcgacctaacccggagacctccctaggctagctcccctcccagaccccaggctctcccacccacctttcccctctccctccctcctccccgtcccacgccgccgcacccccgcctggctgcttgggtggcaatcggccgtagaggaggagggtgtaggagcttgatccgggccacctgccccctgcgccgtcgggatgtacgtgccgccgccgcccaccggcggcgccggcgagcagcctagggtttaccaggtctggcggggaagcaacgaattcttcttgcagggaagattcatatttgggcctgatgtgagatctgtgtttctcactatgttcctcatcatcgcaccagtggttgtcttctgtgtgttcgtcgcaaggcatctcataaatgatttccccgatagctggggaatctcagtgatggtagtagtggttgtcttcactgtttatgatttgacgctgcttctttgtacctctggtagagatcctggtataatacctcggaatactcatcctcctgaacctgaatccattgatgggatcaatgatacaggtgttcagactccacaacaatttcgtttgcctcgcacaaaggaagttgttgtaaatgggatcagtgtacgggtaaaatactgtgatacttgcatgttgtaccgaccacctcgatgctcacactgttccatttgcaataactgtgtggaacggtttgatcatcactgtccatgggtcggccagtgcataggactgcgtaattatcggttcttctatatgtttgtatcctcgacaacattgctctgcctgtatgtatttgccttctgttgggtgtatgtgatcaagattagagcagctgagcacttgtcaatttggaaggccttgttgaagacaccagcatcaattgttctgattatctactgttttctttgtgtatggtttgtgggtggtttatctgtcttccatttgtacctgatgggcactaaccagacaacatacgagaatttcaggtatcgctatgaccggcgcgataatccatataacagaggtactctgaacaattttctagagatattctgcaccgctatccccccttcgaagaacaatttccgggcaagggtgacagtagagcaagggctgcagcaaacacgctcacagtctaggggtttcatgagccccagcatgggcaagccaaccatcggagagcttgagatgggcaggaagccagtagtaccttgggacgagccaaggacggcagctgatatcagggacttggaagcagggttcgggggcatgtttgacgagaaagagggcagagtagcccacgcatccccagatctgagcagagatctcccagcagagtttgtggaagggcgaactggcatgcactcgaggcagtcaagttgggttcagagaggaggcgatgcgagtgaagcgtcggcgctgcaaatggctactgtccataccgccgaagatagcaaccatgtcccctggagtggcacacgttagcctgacaaaaaggcgggggaaaaaaaaaaggagaggaactacggtgtgtttcggttgtgtctcgaggtgggtgctggtggcgatgtcgtctcgaagtgaactgccatgtgtttattaccacgtgtgccagggcaaggccctggatcattttgtaatccgaaacacaagcttgctgctgtagtctcatctcatgcctggtagatcaccagatccctgctgtggttgttttttttttgtttttggtttggcttgttttgttttgcttgtttgtctgtttgggtgtgtgtttcaacaaaatgaagtagccgacgagcctaagctcc

SEQ ID NO: 8970 - DNA, 1028 bp, Zea mays
ccctgccgcgccgtccgcacgcgcgcgcacgacgcacagtcacagatagatacctttcctctcttctcccgtccggccgtcccctcttccgcggcaaccccggcgcggcatggcgagcccgtcctcctcatctttcccgtcccggaaggccctgagcaagatcgcctgcaggcgcctgcagaaggagctaacggagtggcaggtcaacccgcccgccggcttcgagcacagggtcaccgacaacctccagaggtgggtcgtcgatgtagccggggcaccaggcacgctctacaccggcgagacctacaaactgcaggtggatttctccgagcattatcccatggaggcacctcaggttatatttctgcatccagcaccgatgcatccacacatttacagtaatggacacatctgtttagatatattgtatgactcgtggtccccagcaatgactgtcagttctatctgtatcagcatattatctatgctgtccagctcaccagcaaagcaacgcccagccgataacgatcgctatgtcaggaactgtcgcaatgggaggtcaccaaaggagaccacgtggtggttccatgacgacactgtgtgatgggtggttccggctgttgtcctgcccgcattttagttgccagactacatgggagatgatctaggcatatttcaagcgacccatttgaccagaaactaacacgctcttctggtttgtaaatgagtgtgcatcagcgtcaggtctctgtacttgttgatccttacaccgtctatagtatgtagaataatgtttgtatctttgtcaatttacggaacagacatgaaatgcaggtcactgttgacttgcaagatttctgaatccttctagttgaaagttgaaacgagggttatatatgcttggtagtctgctccagatgcagcagctttagctctagttccacttaactctagctcaaactatggcagagctcttttgggagtggctgtgtgatcgtgtaataatatatctgttgtgtgagtattgc

SEQ ID NO: 8971 - DNA, 1857 bp, Zea mays
ctgcttgcttccacagctccaccatcatcatcgcgtaatcctgcaggtgcagctaccgcctatcggcatcctatcgccgcttcgcttcgagacggaaggctgtcccgcgaggggtggagccgagaggagttcgccgtccgagaaggtctgtcttcgggatctccctttggcggcgcagttgttttgatgggaactcagtaaccgctcgagaggaaaggagcggatgctcaactgtagcaggaagatgggtagatccgcgagtgttcttcaagtccttctggtttccgcaaccatcgttgttgctcagacccaatgggctagtggtgtatggggcatgtactgcgaggacttgacagcgagtgcagaaaggccgcacagggcctcggtaacagatttcggcgccgtcggagatggtgcgactcttaacacgaaggcgtttcagaatgcgctcttccacctcgactcattcgcgaagaagggcggggcgcagctgttcgtgcctgctgggaggtggttgactgggagttttagcctgatcagccatctcacgctatcgctggacaaggacgcagtgattcttggatcaccagactcctctgactggccagtgattgatgctcttccatcctatgggcgcggtagagaactccccggcaaaagacatcaaagtctaatatttggatccaatcttaccgatgtgataataaccggtgccaatggcaccgtcgatggccagggtgcggtttggtgggactggtttcacaaccacacattgaactatactagaccaccactcgttgagctgatgtactctaccagagttgttatttccaacctgaccttcataaattcgccgttctggaatatccatcctgtgtactgcagccaggttctggtccagcatctcacaatcctagcacctatcagttcaccaaacaccgacggcatcgatccagactcatctacaaacgtctgcatcgaagactgctacgtcagaaacggcgacgacatagtcgtcatcaagagcgggtgggacgagtacggcatctccttcgcccaccccagctccaacatcagcatccgcaacatcacaggacagacaaggaacagcgccgggctcgcctttggaagcgagatgtcaggcggcatatcggacgtccgagcggagggggtccggatcgtcaactcggtgcacggtatccgcatcaagacggccccggggcgcggagggtacgtgaagaacgtgtatgtagctgacgtcagcttcgacaatgtttccatagccatcaggatcactggaaactatggtgaacaccctgacgatggctacgacaggaacgcgcttcccaccataagcaacataaccatcaaggatgtcgtgggtgtcaacattggtgttgcaggaatgctgcagggcattccgggggatagcttcagtggcatctgcttgtcaaatgtttctctaagtgtcaggtctactgatccatggaattgttcacttgtcgaagggtattcgagctctgtgtcacctgaggtgtgcgaacaactgagagccactcctgggtccggacagatgtgctatggaggtaactatccggcagctgcggcacaaccgcagccgccgcagaagtcaggtgctagccggctggtaagtcctttcctctcgataagttggtttctacgtaggtaaccttgagcatagtatctacttatcatccccccctacttcccagcagcttggtaattgtagtttatggagttcagtaccatgtagtcttgttccaaaaactatttgctggggcatgtaagtactgattattcttactcagaaatggagtggatttgtttgacttgaac

SEQ ID NO: 8972 - DNA, 1748 bp, Zea mays
caaggtggcggccagagagtagagatagagagagagtgggactatagagacgttaccgttgctgcttgttattattaacgccgccgccgcctcctgcattcgtatggtccgcgtcgtcacggggctcctccgtccgtaaggcaccgccgcagcgtctcggctggatcaacaggccggccgatccgtcttcttcccctcctcctgcgggtcggcgtttggggatcatggcggcgcgggcggctgacgagaacaggagaccggcggcagggaagcccgcgccaggcgtccgagacatggcgagccggcgcgcgctcacggacatcaagaacctcgtcggggctgccccgtacccctacgccgtcgccaagaagcccatgctgcagaagagcaaaagggacgaaaagcagccagcgttggcaagcagccggcccatgacaaggaaattcgtcgcctccttggcgagcaagggccaacctgaatgtcagccgatcgtagctgatccagaacccgaagtttgtcaacagaaggaatcagtaggcgatggcaccgttgatattgacgtggaactctacgagctggtcgacggtagtgatagtgacatcgacatgggtgcgacagagaacaaggacattatgaacgaagatgaattgctcatggatattgacagtgcagactcggggaacccgcttgctgcaacagaatatgttaaagagctttacaccttttacagagaaaatgaggctaagagttgtgtaaggccagattacatgtccagccaacaagacataaactcaaagatgagagcaattctgattgactggctgattgaggttcactacaagtttgaactgatggatgagacgctctttcttatggtaaacataatagatagattcttggaaaaggaagtggttccaaggaagaagctacaactggttggagtcacagctatgctgctcgcttgtaaatatgaggaggtatctgttccagttgttgaggaccttgtgctgatatctgaccgtgcctacacaaaagggcaaattttagaaatggaaaagttgattctgaacacgctgcagttcaacatgtctgttccaacaccttatgtcttcatgaagaggtttctgaaagctgcagatgcagataaacagcttgagctagcgtcatttttcatgctggagctctgcttggtagaataccaaatgctgaattatcggccttcgcatctggctgctgctgcggtttatactgcacagtgtgctatcaatcgttgccagcactggacaaaggtctgcgagtctcatagcagatacactagcgaccaactcctggagtgctcgaggatgatggtagattttcaccagaaggctggaaccagtaagctcactggcgtgcacaggaagtacagtacctacaagttcggttgcgtggccaagattttgcctgcgcagttcctgctggagtcgggagggacaccgcctccttcaggtgcaaactagttgaatcgacctattcaactgggtggattttttaaagtttttagaatactccatgaacaagatgcagaaaacatcgtgttgatgttgcccaaaagtgcatcgaatttctttggagagttatgattaacaactttttttttatctatgttgaatgacgagtgacggtcggtcacgttgtgcttgtgcagttatactgcggctaataacaaactgtccagttattctaaaaaacaacgaacgatgttcagg

SEQ ID NO: 8973 - DNA, 744 bp, Zea mays
cagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctacggaggcggtggcggctacggcgttggcgcgagggtggcggtggcggctacggcggcggtggcggcggcggctggagggactgatgtgtgggcccatcctggcttcggccgagttatcttatctatctatagtatcgtgttaccgttcgcttctgtcaccgtgttagtgtccgttctacctttggattaggtgttggtaccctgttgttcgctttggttgctcccgctatgaaacgagacgagagaagaatgagcaaggtttttgttcgc

SEQ ID NO: 8974 - DNA, 1017 bp, Zea mays
ccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcaggaaaaagagtggttgtccatggttgctgcacacagtgatgcatggttactttctgttgcattttacttcggtgctcgattcggtttcaataaaaatgacaggaagcgcctctacagtttgattgatgatcttcccatggcttttgaaattgttagtgggaagagtgaaaccaaggcaccagcaccaccaagcagtagtaaccacagcaatatcaaaccgaagtccaacaacaaaaagaaaccaccggagcctaaggtgaagcagccaaagccgcgtgcccctgcagaggaaggcgaggaggaagatggcagtgcaagcgagggcgagcacggggagacgctgtgcggcgcgtgcaaggaaagctacggccccgacgagttttggatctgctgcgacctctgcgagaagtggttccacggcaagtgcgtcaagatcacggcggccaaggccgagcacatcaagcagtacaagtgcccgtcctgcaccggtggcggtggcgtcggcaacggcggcaccaagcgagcccgcccatcatagctgcgacttttagtgatgtaaactgcttagaaaaactgttgcggacatagcgcccatcatagctgcgactttttaaatggtggtgtaaacttttgtagtgcgactaggccgtttgtcaccctatcatacttggcttcaagtaggttttctgtttttcagttttcattatc

SEQ ID NO: 8975 - DNA, 1280 bp, Zea mays
cgcctctccctcctcttcctctcaacaccaccggcatacccatggcgaagtacggcgagggcgacaagcggtggatcgtggaggagcgcgccgatggcaccaacgtccacaactggcactgggcggagcgcgactgcatcgagtggtcccgcgcgcggctctcctcgctgctcgcgggcctcaccgtcctcgacggcgaggacggcctcacgctccgcaccgtcgcgctcgacaatctcgacggcgaggcctacgtcaacatccgcaagggcaaggtcatcccagggtacgagctctcgctcaccctctcttgggaggccgaggccgcttcggagtccggagctgtgaaggtcgccggcaccgccgaggtcccctaccttgccgacgagaacgctgacgaggaccccgacctccacatcaccgtgcgcggtgacgagacgcccctcgcgctccgcgccaaagatgccttcctctcccgcggcaaacccatggtgctcgaaaagatccgggagttcgttgctgccatggccaagggtggaccggcgaaggacgagctggattccaagaaaactcctgcgaaggtcgccgctgcagcgcctggcgccgctccggcgaagaaagaggaggtggtggctcctgcgccggctgcggggaagaaaaaggccaaggggaaggacaaggaggggttcaagaccattaagatgacggagacgttctactgccgctcaaaggacatatatgagatcttgatggatgagaacagatggaaagggtttacacagagcaatgcgaagatcagtagagaggttggaggggaatttagcctctttgatgggtgcatcactggcgtcaacgaggatctgcaggaaggaaaactgattgcgcagaaatggcggtttggaagctggcctgacggcttgtactcctcggtccggttgatgttggatgagcccgagtctggagttacagtcataaaactcaaacaaactggtgtgccagaggaagacaagtatgggaattcaactgtggttgagaacacggagagaggctggagagatctcatattccagcggatacgtgggatgtttggttttgggatctaaagagtctatagagaggcgatttaatttggcatgatgtcctaattcaaatttttacggggtcaggccatgaatgctatagcaatccatgtttctcacccagttttttttcttcatgtcggcaaaacgcaaaactctgcatatgatggggatttgaaaacatctgttattcatcaggct

SEQ ID NO: 8976 - DNA, 782 bp, Zea mays
acttgagcagactagcaaggccttcagaccgggagggctccctgtcctgtcccccgcgccgccgcggatggccggagccaccacgccggcatcaggcgccctcgtcaggctctgcctgccttcgctcctcctctttctgtaccgatgtgaggctgttgagatggagagaacccttgcgatgatcaagcccgatggtttgtcaggtaagtacacagaagcaatcaaggaggtcatcttggattctggatttcatatcgtcaaagaaaccgaggtccagcttgatgctgagagggcatctgtcttctatgcggagcattcccagagaagcttctttgacagcctagtcaagtacataacaagtggtccagttcttgctatggttctggaaagacctgacgccgttgcgcaatggcgcactttgattggaccaactgatgcaaaaaaggccaaaacctctcatccaaacagcattagagcaatgtgtgggctggactctgagaaaaattgcgtgcatggttcggattcaccagaatctgcagacagagagatctcatttttcttcggagaagctgaatccgtaactgtggaacatgatgagctatagacgccacactggtatcaggcaagtcagcaaactgaattttgatgtgtctttgaactcttaggctatctcctgtagcttcttactcgtacccgtttcttattattttaaaagttattatgtaaacagtataatttatagtgcaaaacagtgtcttgcatggccatatgcttgtggcttc

SEQ ID NO: 8977 - DNA, 594 bp, Zea mays
gtcagggctgagtgtgccacaagtggatcattggaggggaggaagaagctgaccactgtgtctccatcggagtcgggcctagtgggttgatcaacatggttgtttgttagttggtcatggtagcactatgaaggtcaagattcttcagtggcatgcagtggcttcttggacgtgggatgcacaggatgagacatgtggcatatgcaggatggcttttgatggctgctgtcctgactgtaagttccctggtgatgattgcccactcatttggggtgtctgcaaccatgcttatcatcttcactgcatactgaagtgggtcaattctcaaacatccacacccctttgccccatgtgccgtagagagtggcagtttaagggctaaggtactatggacatctagaactgcaccaagcgactctcagttctcagagaagactgatgtttttctggtacttctgtgatgctttattttaactactacatattgttttccgtacttagtataaatcctgatgtcagcgcctgatcctgtgtatgcttccaagcttgtagtggaacaaatgaaattattgcttttcttagggctgatttcct

SEQ ID NO: 8978 - DNA, 1237 bp, Zea mays
gcgccgccgcttcgttcgtgtcgaggggagaagaggaaatggcggcgagcgagggcgtgctcctggggatgggcaaccccctcctcgacatctccgccgttgtcgatgacgccttcctagcaaagtatgacatcaagctgaacaatgccattctcgctgaggagaagcacttgcctatgtatgatgagttggctagcaacagcaatgttgaatatattgctggaggagccacccagaactctatcagggttgcccaatggatgcttcaaactcctggtgcaacaagttacatgggatgcattgggaaggacaagtttggtgaggagatgaagaaaaatgctcaagctgcaggagttactgctcattactatgaggatgagactgctcctactggcacatgtgctgtatgtgttgttggtggtgaaaggtcattgattgcaaatctgtcggcggcaaactgttacaaatctgagcatctcaagagaccagagaactgggcactagttgagaaggcaaaatacatctacattgctggatttttccttacggtgtcacctgattctatccagttagttgctgagcatgctgcaacaaataacaaggtgttcctcatgaacctctctgctcccttcatctgtgagtttttctgtgatgcccaagagaaggtcttcccgtatgctgacttcatcttcggcaatgaaaccgaggcaaaaatcttcgccaaagttcgaggatgggagacagagaatgtcgaggagattgctttgaagatctctcagcttcctttggcttcaggcaagcaaaagaggactgctgtgattactcaaggcgctgatccagtggttgttgctgaggatgggaaggtgaaaacgttccctgtgatcctattgcccaaggagaagcttgttgacaccaacggcgcaggtgacgctttcgtcggaggctttctctctcggctggtccagggcaagagcatcgaggactgcgtgacggctggttgctacgccgccaatgttatcatccagcgcccaggttgtacctacccagagaagcctgacttcaactagtgcaatactcaggcacgttacgagcggttcggcgtgtacactcccctgtatcctttccggtccggccaattttttgtcgccgtgatatttgttcagcaactatggacgacgtcgcctctgttctgtacgaggcatggtttgccatcattattctgttagcttcggcgatg

SEQ ID NO: 8979 - DNA, 1034 bp, Zea mays
gttctgctttaccactcaatctggttgagagtcgccggcgccggcgattcctcctccaccgattcgcccggcgggagtctccgcagggctcaccgggaccgcgggtccacgatggccgccaacttctggacgtcgtcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgtgacgtgttgatgaactacttgatagattcaatgcaagaaccccatggaattgtttgtgt

SEQ ID NO: 8980 - DNA, 830 bp, Zea mays
attgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactagcagcattgaactctgctgcttatttacagcagcaacaactactaccattcagccagctagctggtgtgagccctgctaccttcttgatacaaccacagttgttgccgttctaccagcacgctgcgcctaacgctggcaccctcttacaactgcaacaattgctgccattcaaccaacttgctttgacaaacccagcagcgttctaccaacaacccatcattggtggtgccctcttttagatttcttatgagttatagttcaataataaagttttttgtctgatgtttgtggcttcccagaaataagaaagtacatttct

SEQ ID NO: 8981 - DNA, 1123 bp, Zea mays
actccaactctccgatctccaggaatccgcggctgaggcgccggcgatggcggctcccatggtcgacgccgaatacctgcgccaggtcgacagggcgcgccgccacctccgcgccctcatctccaacaagggatgcgccccgatcatgctccgcctcgcatggcatgatgctggaacttatgacctgaagacaaaaactggtggtgcaaatggttcgattagatatgaagaagagtacactcatggttcaaatgctggtttaaagattgctatcgatctccttgagcctatcaaagcaaagaatccaaagataacatatgcagacctgtatcagcttgctggagtggttgcagtcgaagtgactggggggccaactgttgaatttattcctggcagacgtgattcgtcggtgtgcccccgtgaagggcgtctgccagatgctaagaaaggtgcaccacatctgagggacatcttttatcggatgggcttatcggacaaagatattgtagctctatcagggggacatactctgggaagggctcaccctgagaggtctggattcgatggtgcctggacaaaggagcctcttaagtttgataactcatactttcttgagctgttgaatgaggaatctgagggacttttaaagctcccaactgacaaggcactgttatcagatcctgaatttaggcgctatgtggagctctatgcaaaggatgaagatgcgttcttcaaagattatgctgaatcacacaagaaactctctgagcttggcttcacgcctcgcagcacagcaccatccaaatcagatcttccaaccgccgccgtgcttgcacagagtgcctttggggtagcagttgctgcagccgtagttatcgctggctacttgtacgaggcttccaagaaggccaagtagagggcgaagttcttctccacatggctttgctttagtaagtctgaagatcgaataacaggaccatatctgaagatcgaataacggatcatataaatgagttactcggaaaatgttctgaaatccttacgaacagaacgttgccttcatgtttacactgtactcatgagtcacagtgatatggagatggcatagcctactattggaagt

SEQ ID NO: 8982 - DNA, 1527 bp, Zea mays
ctcgttctctccttcctatcggctccacacctccacgcaactggaagcttcgcttcaatctgccctactcctccgccgcctccaacaccgcagacgcagctgccgcgggcgggagcttggacgtgctactctgctctcatctcgtttccgcgcaggaattgttcacaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtcgcagtcgcagtcgcagtcgcagtcgcagcaggagcagaagccgcagccgcagccgcagccctagataccgcaggagtccaagctatagtagaaggagctatagccctcgttatcgctctccaaggcgccgtagtccttcgccaactcgcgcgcgcagctatagcaggtcaccatagtacaactgcaacgagtatgtatctctattgctaatggtgctgttatgcacaggtaatggtggcaggtactggtgtagcaggagctaggcctgaagcccgtgcctgatacttcttggtgtgagaacttagtccttggtttggctgtcaggaacaaatttggaactgtcgtcaactgcatgacttcagttcaggcatgttctgcttaaacgactcggccaactacggctctcagttagtcttcatggttttgttcctccattcttggcacgtccttatctgcaaacaaatgtcaacgttccattactagctgccttcgatgtttcatcatgaaattcttcaccgaagatgcaacttcatcacaaattagtaacatcctttcccctcatatagttgataaggtttgagtgtactgagcactaacaaatgcagctcgcgaaagtaagaccccttttcgtcatagaacaagacagctattttaattgcagcactcgtgtgaaaatatatctactctgcatggtgggattggggcgattgaagtgtgtggccttcagctgcacctagttgggcatcccaggaacctagtcaggctgactacagcaagaggcgcatcctttgactaaacatgtttgttttatttcttgtggtttgattcttcacttctgttcattgtgttctgccttcactgcaccctattggattggtagtggtcgaacaatgcttctgtctgtggtaagttattcttggtacaatggctcttctttacccctgatcagtgtatgttggactttctgatagagttagcaccaattgtagtataaatatgttcttttttctctgg

SEQ ID NO: 8983 - DNA, 1953 bp, Zea mays
caaagctcgcgccgcccaccgcacccgatccgcctcgcccaggcgtgctgccgtccgctcccttctcccgcgccgtcgcctccgcctacgcccgggccgacccgctggacccagcgtgcgccgctccactcggacgcgccgccgccctctcgggttgaggcggaggtgcttggggacccgcccccatggcgagcgccggcaacagcggcagcggggacgacgatgcaggagggaagctcctggcggatcgctaccagaagggcgaggtcctcggcgagggcacgtatggagtcgtcttcaaggccatcgacaccaagactggaaatacagtcgcggtaaagcgaatccggataggaaaggacaagaaggaaggtgtcaacttcactgcgttgagggaaattaaactacttaaggagctgaaagatcctaatattatagagctgattgattgtttcccttacaaggaaaatttgcaccttgtgtttgagtttatggagaccgatctggaagctctcataaaagataagaacataatactctctccagctgacacaaaatcatatgtccagatgatgttaaaaggtctagcgttctgccataagaaatgggtgctacacagggatatgaaaccaaataatttactcattggtgccgatgggcagctcaagcttgctgacttcggtctggcccgtgtgttcgggagtccaggaaggaacttcactcaccaggtctttgcacgttggtaccgggcaccagaattattatttggctcgaagcagtacggatctggggtggatatttgggccgctggatgtatttttgctgaactgcttactcgcagagcctttctccagggttctagtgacattgatcaacttgggaagattttcgcagcacttgggaccccaaaatcttctcaatggcctgacatggtttatcttcctgattatgttgaataccaatatgttgctgcacctccactacgtacgttgtttccaatggccagcgatgatgctttggatcttctgtcaaaaatgcttacctatgatccaaaagcaagaatcagtgctcagcaggctctagaacacaggtacttttcatcgttacctgcaccaacaagaccatcgcagcttccaaggccacgtcggaaaggagatcaagggaataacaagattcctgatctcaacctgcaggatggccctatggtgctctccccgccaagaaagttacgtagggtgacagcgcatgaagggatggaaggtatgcacaggacagataaagtggacgaacatccttctgggatgaggcacaccgatgacatgcccagtcagagttctagaattccaatgtcagttgatgttggggctgtgtttggcacacgacctgcacctaggccaacattgaacagtgcggacaagtctcgtttaaaacggaaacttgatatggatccagagtttggatacgcggagtagaaggaacacatgtttacatgcaccattcttttcttattggggatgttgatttttaaaataagattctgacacaatcaactgagatgttaccgtcatcgcctcacgaagaggaaaactgaagagagattattctaatttatcccgagtcacatagggtattacagctaaccaattccgtaaggcaggctcttgaaaacagtagactcaatgggatattcatgagtggagagtgttatggggaattggaggatggaaaagcttgctccatgcgtgtttgtacgtgttttgccaagattgtgctgaagcatctgatctatctactgattctctattttccgtactgtcaattcccgttcttgtatggacagagctttgagcatgttttcagtcagacaccttaggcagtgattcttattgtacaacttatatcatctgacatttcttttgagatgattaaacaatgcatggcgaaaaagggggg

SEQ ID NO: 8984 - DNA, 1455 bp, Zea mays
cttcttcagtctcccgtcttcttctggtgccaacacatcctcattctcagggtcgccctctcgattctccctcaagtccagtccagccggatcagtccccttcccctcctccacaaggcgccgcctcccgcagatccgaattggaatctgggccttcgtctccgcaccacaaatccgggaagggaagggaagtgatgggggagtgcgaggacggcaaggagtacaggtgctgggaggagctgctgccggacgcgctggggctcatcttccgcaacctgccgctccaggaggtgctcaccgtcctgccgcgggtgtgcaagtcctgggggcgggtggtcgccggcccctactgctggcaggagatcgacatcgaggagtggagccagcagcagagcaagcccgagcagatcggccgcatggtggagctgctcgtcggccgcagcggcggctcgtgccgccggatcagcgtctccgggctgccctgcgatccgctcttctcgttcatcgcagacaatgcgcgagctcttgggaccttggagatccccaggagtgagatcagcgactccgtagtggaagccgtggcgccgcggctatcgaacgtgacgttcctagacatcagcagctgcacgaagatcggagcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggctgcgcgtcctgggcccgcgcgtcgtcgacgactgctacgagaacagctactgggaggagtgctccgactactactcggacgaggacgaggactacgacgacgacgtcgtctcgtgggggttgttcgtggacgacgacgacgactactactacgccgtcggcagcgacgacgacgaggctatctgggacgacgcgcagggcctggagaacctcgaggtgaggttctacggcggcggtggcttcggcgagagcttcgccggcttcgactggccgccgtcgccgtgacgtggcccgcgagagccgctgctgcgcttgcgttgcgcggaccgtttgcggctcttgcttatataccgcgtgcgtgcctgagtcgttgtttgttgttcgtcccaagctttgtttgcagatgtgtgctttcaatctttaagctctagcttgcagatatgtgaagtggactgctagtagtagtacactctagctgtaaaactccggtgtttacctgaagcaaaccagcatgcactggtgagatttcaccggcgcc

SEQ ID NO: 8985 - DNA, 2221 bp, Zea mays
tggaaggtcgtctcgccatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcggaccttgtgaacaaccttggtaccattgcacgatctggcacaaaagagttcatggaggcactggctgctggtgccgatgtgtccatgattggtcagtttggtgtcggtttctactcggcataccttgttgctgagagggttgtcgtgaccaccaagcacaacgatgatgagcagtatgtatgggagtctcaggccggtggctccttcactgtcacacgtgatacctctggggagcaacttggcaggggtacaaagatgaccctgtacctcaaggatgatcagttggagtatcttgaggagcgccgcctgaaggatctgatcaagaagcactcagagttcattagctacccaatctctctctggactgagaagaccactgagaaggaaatttctgatgatgaggatgaggaagataagaaggacgaggagggcaaggttgaggatgttgatgagaaggaagaaaaggaaaagaagaagaagaagatcaaggaggtttctcatgagtggcaattggttaacaagcagaagcctatctggatgaggaagcctgaggatattaccaaggaagagtatgctgctttctacaagagcttgaccaacgactgggaggagcatctcgccgtgaagcacttctctgttgagggtcagcttgagttcaaggctgtcctgtttgtgccgaagagggccccctttgacctctttgacaccaggaagaagccgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctacgagtccttctcgaagaacctgaagcttggcatccatgaggactccacgaacaggaacaagattgcggagctgctgaggtaccactccaccaagagcggagatgagctgacaagcctcaaggactatgtgacgaggatgaaggagggccagaatgacatctactacatcactggcgagagcaagaaggccgtggagaactcccccttcctcgagaagctgaagaagaagggctatgaagtcctgtacatggtggacgccatcgatgagtatgctattggccagctcaaggagttcgagggcaagaagctcgtctcggccaccaaggagggcctgaagctcgacgagagtgaggatgagaagaagcggaaggaggagctcaaggagaagttcgagggcctgtgcaaggtgatcaaggaggtgctgggcgacaaggtggagaaggttgtggtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggagaacgccatcatggaggagctgcgcaagcgcgcggaggccgacaagaacgacaagtctgtcaaggaccttgtcatgcttctgttcgagacggcgctgctcacctcgggcttcagccttgacgaccccaacaccttcggcagccgcatccaccgcatgctcaagctgggcctcagcatcgacgaggacgaggctccggaggccgacaccgacatgcctcctctggaggatgacgctggcgagagcaagatggaggaggtggactagtctggctatcgtgtcttaatttgtgtgtgtgcgtgtgtttttttttacttctgctagcctgcaaacttcttacgtttattattgtgggtataatagtgctcctgctgccc

SEQ ID NO: 8986 - DNA, 1110 bp, Zea mays
tttgttcctcactggtttgctggaggcagtggtagctgcccttttcatgaatatctatattgttggactgaaccagttattcgacattgagatagacaaggttaacaagccaactcttccattggcatctggggaatacacccttgcaactggggttgcaatagtttcggtctttgccgctatgagctttggccttggatgggctgttggatcacaacctctgttttgggctcttttcataagctttgttcttgggactgcatattcaatcaatctgccgtaccttcgatggaagagatttgctgttgttgcagcactgtgcatattagcagttcgtgcagtgattgttcagctggccttttttctccacattcagacttttgttttcaggagaccggcagtgttttctaggccattattatttgcaactggatttatgacgttcttctctgttgtaatagcactattcaaggatatacctgacatcgaaggggaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggtaccccacgctgcttgatgatatcccatgtgtccgggtgaccggacctgatcgtctctagagagattggttgcacaacgtccaacatagcccgtaggtattgctaccactgctagtatgatactccttcctagtc

SEQ ID NO: 8987 - DNA, 970 bp, Zea mays
caccgcttacttgactcctcccgaacttccacatctctgctctgccttcccagtctcccatccctgaaaacctcacaaaaccctcgctcgctccccaccaccccgccgcgccgccgcctgtaccagctgcgtcaagatgagtcggcaccctgaggtgaagtgggctcagaggatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggtggtatgggcggcatgggtggcatgggtgatatggctggtatgggtggtcttggtggcatgggtggtatgggtggtcttggtggcatgggcggtatgggaatggatgatttcgaagatgagagtgatgatgaagaagtgtcgaaacctcaagctgcggacaaggctgttgaggctgaggagacggagtcagcggaaaccaagattgaggcggctcagagcagttgaagatgcttatgatctaagctagattgtatcctcatgttaattctgctgaatcggaggacaaaccttacatttatggtgctggcaagtcccagtggcgtgccatgaaaatttacgttccgtcttttaactgggtatccgagtgtcgtgctcagcatattatggatattatttccgtaatgcttcctttggtcgccaatcatgtggtgaagagtttgtttt

SEQ ID NO: 8988 - DNA, 1231 bp, Zea mays
caagagcaagagcaagagcaattactgcaaaaccctaaattagctacgtatagcttctcttctcacccatggccaagtcaagcagctacggccttgggcttgcttgcttcttcgccattgccgctgcggtcgccggcgggacgcagttcatggtcggcggcgccaatggctggagcgtgcccaccgccggcgccgagcccttcaacacttgggcggagaggacgaggtttcagatcggagactccctagtgttcgtgtaccccaaggaccaggactcggtgctgctggtggagccggcggactacaacgcctgcgacacgtcgtcgtacgtgaggaagttcgacgacggcgacaccgtggtcacgctcgaccgctccggcccgctcttcttcatcagcggcgtcgaggccaactgccgcgccaacgagaagctcatcgtcatggtcctcgccgcccgcagcaacggcaacggcaccggcggcggcgcgcgggctccgagcacggcgccgcagccggcgtcaccggcggcatcgccccctcccgccagctcgaccccgcccccgccgtcgtcgcccgctcccaagggcgcgtcgccgcccccggcctctgctcccacaacgtcaccgggtacgacgccgccccctgctccgagcgcgtcgtcgcctgctccggcggggagcgagacgcggacgaggagacgcggaaccagatgatgcagaacctattcggagaccagtcggaggacgaggacgatgcggacgacgacgacggccagcagcaacagctgcagtcacccccgcaccaccaccacgagatagaggacgacgccgatgaagacggcgacgacgcccgcagcgacgcgcctgcccgccacggcggataccactcggaagaagtggatggagaggcagagaatggaggagaaggtgaaggcgaaagtgaggggcaagttgaaatggaagaggaaagtgaaggcgaagctcatcgtgctgaccttgatcaaggagaaagtgatggggacaaagtccatagctccccagaaagagaactccatgaccagaggatggaatctgatgcaaaaggactggatagtgaagatgaaggctaccagcagaggacagtatctagcagaagaaggggagttgttgcctctgaatcagagggatctgaagataattactatgctgatggagctcaagaagatgaggaacctcgccaaacaaggaaacaa

SEQ ID NO: 8989 - DNA, 2096 bp, Zea mays
gcagaacgctcaacggctgtgctgccaaaagtccggaccacagctcgcgccgcccgccgcgccttgcccagacgtgcgctcccttctcccgcgccgtcgcctctgccctggccgacccgctgggcccagtgtgcgcagccctcccgggttaaggcggaggtgcttggggacccgctcccatggcgagcgccggcatcagcggcagcggggacgacgatgcaggagggaagctcttggcggatcgctaccagaagggcgaggtcctcggcgagggcacgtacggagtcgtcttcaaggccatcgacaccaagactggaaatacagtcgcggtaaagagaatctgggtagggaaggacaagaaggaaggtgttaacttcaccgcattgagggaaattaaactacttaaggagctgaaaggtcctaatattatagagctgattgattgtttcccttacaaggaaaatttgcaccttgtatttgagtttatggaaactgatctggaagctctcataaaagataagaacataatactgtctccagctgacacaaaatcatatctccagatgctgttaaaaggtctatcgttctgtcataagaaatgggtgatacacagggatatgaagccaaataatttactcattggtgccgatgggcagctcaagcttgctgactttggtctggcccggatgtttgggagtccaggaaggaacttcactcaccaggcacatgaatttttactgtttttacacgtaggtctttgcacgttggtaccgggcaccagaattattatttggttcgaagcactatggatctggggtggatatttgggccgctggatgtatttttgctgaactgcttactcgcagagcctttctccagggttctagtgacattgatcaacttgggaagattttcgcagcacttgggaccccaaaatcttctcaatggcctgacatggtgtatcttcctgattatgttgaataccaatatgttgctgcaccaccgctacgtacattgcttccgatggccagcgatgatgctttggatcttttgtcaagaatgcttacgtatgatccgaaagcaagaatcagtgctcagcaggctctagagcacaggtacttttcatcgttacctgctccaacaagaccatcacagcttctaaggtcacggtggaaaggagatcaagggaataacaagatgcccgatctgaacctgcagcatggccctctggtgctctctccgccaagaaagttacgtagggtgatagcgcatgaatggatggaaggtatgcacagagcagataaagtggacgagcatccttctgggatgaggcacaccgatgacatgcccagtcagaagagttctagaattccaatgtcagttgatgttggagctttgtttggcacacgacctgcacctaggccaacattgaacagtgcggacaagtctcgtttaaaacggaaacttgatatggatccagagtttggatttgcggagtaaaagaaactttgttaacgtgcaccattcttttcttactgagatgttggtttcgaaaatattctttgggagatatttccacagttcactcagagaagaggattgcattgaagccacaaaactgcaccgaaggattctgacacgatcaactgggctgttaccgtcatcggctcacgaagaggaaaactaaggagaggtcattctgatttatcctgagtcgcatggggtattatagctaaccgattccgtaaagaaggctcttagaaacagcatgctctatgccatgcgagtggagagtgttatgtggaattgggggcatagaaacgctcgctccagttagaaatgtgtgtttgtgctaaatgtgatctactagtcctccattctccgtggtttcaatttccttcaattcttgtacggacacttagctttgagcattcttcactcagccactctacgtatagtgatttttattgtaactaagagcagtgattttattgtaactaagggcagtgattttattgtaactaagagcaattgttgtgttctcgaaccaacattcaaaactgaataacacgatatcagcgcaatgtggacgatat

SEQ ID NO: 8990 - DNA, 2255 bp, Zea mays
cagccagagggacatcaaactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacaggtatatatagcccttgtatgtgtttctaatctgcagatactattgtccctgggcactggcagagctcatccgctaccatctggcagcagttccaatgatacatgacaccagcagcagcagagcatccacggcgtgccactactcgccgtcgcttgtggcagaggagcagcttcacggctccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaatttattagcagtgaagaggatgatgatgattctatttcggagagctcttcagcatcattggccaaaccagctggaactttggatcttggcaagctgacagaggaaccacagttggatgtaccacagcctcaccgccgcagtgtggatccaaaccattcgtatgatcaagtgtttattagatccactcggttactggagaggagatccaagaaacgcaacggcggccacagggctttggataatggtgtggcgtgcagtggtgtgaactcaaagagaaaagacaagtttggcagagttcttgatccagacgagccttttaggttgtttctacgggatcgagagacgacagagttcttgacagcgaaagaggagaaacagatgttcagtcaaatacaggatcttatgaagctggaggaggctcagcgtaacctgcaagctcagtgtggtcgtgaaccaacagttgaagagtgggctcaagccgtaggaatgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccggtattaattgactgtttgttatgatcaattatatatagggcctctatttcatatttcgccgtgggctcctaaaaagtcaggaacggccctggttgcaggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggtacatcactagttgcttgatcatggatgcattcattcatcattcactgcactgatggtggatgatgatcttcttgcatgcaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagaccaagaattcatgtttttttcctttcccttttgccatttgacattcattcatccttgtactcaacaatggatactcatacatggttgtttgaggagcaaagcttactttaaatgtatggatgtacgtttaagtgcacatatgtttatgaaacctctctttgtttc

SEQ ID NO: 8991 - DNA, 3332 bp, Zea mays
caccactctctagtctcaccgccccccgtcccgctcattggacgagacgacggacccttcctttctcgcacgggaagagtagcgaggaggcgcggcgcccgtgcggcgtatgcccgtgcctgccgtcgggctccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacggtggtggcaagcccccggactggcaggacttcgtcggtatcatcgtgctcttggttatcaactccaccatctccttcattgaggagaacaatgccggcaacgccgccgccgcactcatggccaaccttgctcccaaaaccaaggttctgagagatggccgatggggcgagcaagaggctgcaatcttggttcctggtgacatcatcagcatcaagcttggcgatatcgtccctgccgacgctcgtctcctcgagggtgatgcactcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctccattggggtcggcatcctcgtcgagatcatcgtcatgttcccaatccagcaccggaagtaccgcagcggaatcgagaacctgttggtcctcttgatcggtggtatcccaatcgccatgcctaccgtgctttcagttaccatggccattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaaggactgagaaccaggacgctatcgatgccgccatggttggcatgcttgctgatcctaaggaggccagggctggtataagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagtcccctggtggaccatggcagttcgttggtctgttgcccctgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatgctacgcttgaagcgcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgatattgtccttactgagccaggtcttagcgtcattatcagcgccgtcctcaccagcagatgcatcttccagaggatgaagaactacaccatctatgcagtttccatcacaatccgtatagtgctcggatttatgctcattgcgttgatctggcaatacgatttctctcccttcatggttcttatcattgccattctcaatgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcaggtgtggtctggctctacagcatcgtcttctacttccccctggacctgctcaagttcttcatccgcttcgtgctcagcggcagggcatgggacaacctcctcgagaacaagaccgccttcaccaccaagaaggactacgggcgggaagagagggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggagtttcttttctctctctcttttcttattgttatgtttttcaatagtggagtgtgcgcgtgttgtaatcgtttttacctgcgttttcctctaactagccggtgatctcgcgggaagcgaggtgaagaaataatgcaactaaaattctctgcc

SEQ ID NO: 8992 - DNA, 1575 bp, Zea mays
gccactagctctccgcagtccgctctcgcctctcggccttctccttgtgccgccgaacaccctcacaagagtcggcctctcgatttctcagtccagcctcagcagtccccttccctccctccatcaggtgttgcctcccgcagatccaaatcggaattcggtccttcgtccccaaaccaccaatccggttgcattctttgggtttgctcacagcgcacacaaagccattttactgctgggaatggtggctggcactattagcgtctccggctcttgagtgatctccaagtcctttggaatgctacagggaagtgaagtgatgggggagtgcgaggacggcaaggagtacaggtgctgggaggagctgctgccggacgcgctgggcctcatcttccgcaacctgccgctgcaggaggtgctcaccgtcctgccgcgggtgtgcaagtcctgggggcgggtggtggccggcccctactgctggcaggagatcgacatcgaggagtggagccagcagcagggcaagccggagcagatcgcccgcatggtcgagctactcgtgggccgcagcgccggctcgtgccgccggatcagcgtctccggcctgccctgcgatccgcgcttctccttcatcggagacaacgcacgagctctccggaccttggagatccccaggagcgagatcagcgactccatggtggaatccgtggcgccgcggctgccgaacgtcactttcctcgacatcagcagctgcacgaagatgggggcccgcggcctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagctcctgccgcgcgaccgccacccggggctgcgcgtcctgggaccccgcgtcgacgactgctacgagaacagctactgggaggagtgctccgacgactactcggacgactcctccatctactcgtgggagctcatggacgacgtcgacgacgactacgactacgccgccggcagcgacgacgacgacgacgaggccgtctgggacgacgacggccagggcctggagaacctggaggtcaggttctacggcggtggcttcggcgagaccttcgccggcttcgactggccgccgtcgccgtgacatgacacctgctgcctgcgcttgcgttgcttgcgtgggtgggtgagcctttgtgtgttgtccccaagctttggaagcttgctgtgctgctgtagtactgtgcctgcgacatcactcgatcttcctctacctcgcagatatgccatatgtgaagcgaactgctagtggtgcaatctaaaatgtagacgctggtgtttacatgaagcaatccccatcagcatgcaccggtgagattccaccggtgccaatccccaaac

SEQ ID NO: 8993 - DNA, 2479 bp, Zea mays
ccctcagcccccctctctctctcgctctcggcgacgactgggcgaccgccgccgccgctgccgctgcgccgcccttgtccaggtgcccaggtcttcgccggcgccttcgccaggtcttcgaagattcagggaatataagtaaaatgaggccagttttttgtgggaaccttgactatgatgttcgcatctcagaggttgagcgcctttttgggaagtatggaagggtggaacgagtggatctaaagacaggttagtctgttactctgttcattgttatgtcctcgaatttaattgtgatctataatagcaaaacaattgttgctcctgcagctatatgtagtttttggtcaaaggcagtcctctatttcattaagtgaattacatccagtgtcagcaactgcagctttgaatcattttctctctccaatttagatactgaagcattactgaatgtatatatatccatccataagacaatgctgctggatttgcatttttttttacaaaattttcaattatttagccatcaaaaacatagcaatgtctttgtttagattttgttttttatcaattgatctgcaatatttgttaaatcacaaatacacgattttcacatgactcctctaagaatgtgatctttgtacggaaactgctatcaccatgatgtggcagagattgtctatcttcacccatgcctggtgcaaagaagctgcaaaaggaccaagttgttacttcatccgttgtgaagccagaggagtttcagcaaaatcagattatgtttatgttttactgttataagtcattggacaagtgtatatcaggataaattagaagaaaaaagttctttcttcaaatttaggtccagtactcaattatttctttgccgcagggatatcatggagcatatgtgctcttcctggttgatggactggctctacctttactgcctctgcctgtgccccatctcatgccttgtccatctccaggagttcacaagtccaccgtggcatctgttcacatggaaacgaccacctcgtgactgatgtcttacttttacgatcaacattgcatcctcctcccccgcctcatcaccatttcctcgccaatccaaccatgccaatctcatggccggctggagagtggagagaagtggaggttgcaccaccaattctttgatgtgccacgaatgtttggattgttgtactctactactctgacatcatttagttcaacataaacaaggtctgttcctgtttattatagtgtatcggactgtagatttgtgaggtgatcttagaaaagattaaaggagagactgcatcatggtttatcttgttgccttttctgtttatgttattggaccatactgtaatttcaagtcacttattctaccttgttcaacatgaagggtttgcatttgtctacatggaagatgaacgcgatgctgaagatgctatcagtagacttgatggaattgattttggcagaaaaggaaggaggatcagggttgagtggacaaaggaggatcgcactgttggccgaaaaagcagctcaaggaggtctccaaccaatacaaaaccgaccaaaaccttgtttgtgatcaactttgacccgatcaacacaagaatccgagatctggagaggcacttcgataaatatggcagggtcgcaaatgtaagaatcaaaaagaactttgcctttatccagtttgaggtacaggaggatgctacaagagcattggagggtactaatggaagccatttcatggacagggtgatctctgttgagtatgcacttcgtgatgacgatgaaaaaggtgaaagagggaacgggtacagcccagacaggagaggtcgtgaaagatccccaggtagaaggcgttctcctagtccctacggtagaggacgggagagaggtagcccagattacgggagaagcaaggagagggggagcccagactatggcaggggaggacgcagccctgataatggcaggggagtaagcccagctggtggtggcagaggcgatcatgccaggggtggagggcgcagtcctgactatgatcgccagcgccgggaagctagtcctccaggttatgacaggtcccccagccgctcacctgggagggaggccagagagtagaagcagcgttccattccatgcctgtgttcaagcatcagatgaatgtgcaagttggtaatgttagccggcaggaaacttgtctactatgcgcgttagctcgtgtttgactttccacccatttcagtatgaagcgacctcagaatgtaactcgtgtagtagtattttttagtggtagctttcagtactggtttgaacctgttgttggctttattttctgagtaaaatgcaccactcgaactttactcattgtgtcacttgggttctgaactcagaaaaccaggtaaacggatcatgaaactttgttggcccatgtaaaaccattcaaagtcagttatat

SEQ ID NO: 8994 - DNA, 1793 bp, Zea mays
cgaagaacacccttctctggtcgtcgcatcgcagggcagctagctaggtagctaacatccgccatggcgcgcgggggagacggcctgcaggtgctgagcgcgctggacgcggcgaagacgcagtggtaccacttcacggccatcatcgtcgccggcatgggcttcttcacggacgcctacgacctcttctgcatctccctcgtcaccaagctgctgggccgcatctactacacggacaccagcaaggacagccccgggtcgctgccgcccaacgtcgcggcggcggtcaacggcgtggccttctgcggcacgctggcggggcagctcttcttcggctggctgggcgacaagctggggcgcaagagcgtgtacgggatgacgctcatggtcatggtcatctgctccgtcgcgtcgggcctctcgttcggccacacccccacgggggtcatggccacgctctgcttcttccgcttctggctcggcttcggcatcggcggcgactaccctctgtcggccaccatcatgtccgagtacgccaacaagaggacccgcggcgccttcatcgccgccgtcttcgccatgcagggcttcggcatcctcgccggcggcatcgtcacgctcgtcatctccgccgccttccgcgcggcgtacccgtccccggcgtacagggacgaccacttcacctccaccgtgccgcaggccgacttcgtgtggcgggtcatcctcatgctcggcgccgcgccggcgctgctcacctactactggcggatgaagatgcccgagacggcgcggtacacggcgctggtggccaagaacgccaagcaggccgcggccgacatgtccaaggtgctgcagactgagatcgtggacgagcaggagaagctggacgccgccgagggcgccaacagcttcggcctcttctccagggagttcgcgcgccgccacggcctccacctcgtcggcaccgccaccacctggttcctgctcgacatcgccttctacagccagaacctgttccagaaggacatcttcaccagcatcaactggatccccaaggccaacaccatgagcgcgctggaggaggtgtaccgcatctcccgcgcgcagacgctcatcgcgctctgcggcacagtcccgggctactggttcaccgtcgcgctcatcgacgtcgtcggccgcttcgccatccagctgctgggcttcttcatgatgaccgtcttcatgctcggcctcgccatcccctaccaccactggaccacgccgggcaaccacatcggcttcgtcgtcatgtacgccttcaccttcttcttcgccaacttcgggcccaacagcaccaccttcatcgtgcccgccgagatcttcccggcgcgcctgcgctccacctgccacggcatctccgccgcctcggggaaggccggggccatcatcggcgcgttcggcttcctgtacgcggcgcagaaccaggacaagagcaagacggacgccggctaccccgcgggcatcggcgtgcgcaactcgctcttcgtcctcgccgccagcaacatgctcggcttcgtcctcacgttcctcgtgccggagtccaagggcaaatcgctcgaggagatgtccggtgaggctgaagactcagaggaggagcccgtcggcgcccgtgcggtgcggccgtcggagacccagatggtgtagagaatcgatcgatcgacgcgtgttccttcctgcactgcacatggtgggctatcatgtcctcaattgttttttttccacgttaagtcaaacctggctgtgttttgatgtgc

SEQ ID NO: 8995 - DNA, 923 bp, Zea mays
gtaaaggatggagaccatgtcggctctcgcgaggacggcgccgccccttgctgggaccattcgccggccgtcctgcgcgctgcggccgacggcgtccctctccttcgccgccgcttcaacgacgccccgcggccggctcgggctggggctgagcacggcgccggcggggagcgggagggcggccagggctcgcgccgtcccgcagcgcatcgtcgcctcctcggaggttgagcgaagctacattatgatcaaaccagatggtgttcagcgtggtctggttggagagattatttctcgctttgagaagaaagggtttttgttgaaaggcttaaaacttttccagtgccccaaggacttggcgcaggagcattacaaggatttgaaggataaacctttctttcctaagctgatcgattacataacttctggccctgttgtctgcatggcctgggagggtgctggtgttgttgcatcagctcgcaaattaataggagctactaacccccttcaagctgaaccagggactataaggggtgatcttgcagttcaaactggaaggaacgttgtccatggaagtgatagtcctgataatggcaagcgtgaaattgaactgtggttcaaagaaggcgagctctgccaatgggaatcagttcaagcaccgtggcttatagaataactcttgctaatcatttccagagttgtattcaatgtttttttttgtgttcgtcttgattcaaggagccatgcaagagtgtatgagtttagttcggctaagtaattagctcatgagggcttgaattatcggttctttttgaggattgaggatttgtgcaactgaaacctttgatcagttgctcatgttgagaagctaatttcttgtcatatttacatgtaataaagtccctctactacagtaataaatt

SEQ ID NO: 8996 - DNA, 2941 bp, Zea mays
tttttggagaattcaagcacatacgagttacaatgacgagttcaaataaattggggcctatgaatgacaggttccttgtattagttgaatggctgccaaatttgtcctaacaatgaaagaatcaaatcagattcagcctcggttgttttgggcgagcttctttgcacgcccattgaacggttgcccatcatcctttgctcccgacgcctcaggcttacgggcccaagcaggagctctgtcaggctcatagcggtaatcgtagaataactcttcaccagcgaggattctttctttggcgaatatgcccactctatgatcaccagttaccatgataaccttggcatagcaattcgggtcaggggcatggttggcaaatttcagcttgtcacccattctgtatgcgtcaagaacatactcattgttcaggttgaaaaggaacgatgagttctcacgatcatatatctttccacgcttatctgcttctttgtgtgagattagttccccagtgtactcaccaaggtattcatgtttgctaacactattcttgaggaatgctccccagccagagacatctgatcttccaagtaagaccctttgttgttgtttaagaagcagtttcatgttccggcattcataattatctcctctctggtttggaactcccaatgtaccatcaccacacccaacccaacagtttctgcaaacatccggatcgcattccctgtcagctgcaaaacatggacattggcggctgcgacactggctctttgcacagtgacatcctcgaaaacgattcttgcaaatttttggacacccacagtatttctcacaacatgtcccatttgaaagacatggacactgctttccgcatgtagattgacaaccacaaggattatattgtcgacaaggctgatccttcctttcggtaatccttttgaaattgtaacctgcagatttccaggtgtacttcaaacgacggactttacctcgccttctaaaatatcttgatcttgtgcgcaactcagtacccttaatatatcctttaacaagagaatcaacaccactaagagctccagaggcactgttgttttcaatataattcatatattgaaaaacatctttgcacgtcttcattccaccaagaaggttccgagcaattaaacaactgttccttccaaaaatctctaatcctttcacaagaagtccctgctcaattgccttccatgatctcaagtacacctcctgcttgcataaattctcattgacgaattcttctttccttgaactatcgtaaccatctgttgctgaatgacggttatttgcttcctctgttgaatcattatgagcctcagcaaaagctgagctgttcccaatttgaggtgtactcttctttttggaacttcttgtgcttggagaactctgttgtgaggatacaattaattccttatttccatttcgtgtatcagacctaagcttcatgtcccttgccaaaagatatccactaacaaaattagaatcagatgatgccatttccctttgtcctttcttcacactcataagaattctctcagcgattcgtctattggtaatctttctgattccacctttcggcccaattttaacttttgagggactaggggagtgttgtggagatttattgcttattggatgtacttccgaatcactgctttctgagataactcttgcagttgaagagctttcactttgttgagatttagtcttccttccactggagccgttctttttcctatttgaacctggctggttcatcacattgtctgatgagtgagttggctcctcaacatcaaaaagcatgtgatcagcaccagcagcagcatctggttcagatgccagtttatggcaatgaataccacagggtacactgtcatcaacgccactccaagctggttgtttttctgtaggaaatactaaatcttgagaacacccatgtagcttgcaatcaaacacctatcagcatcaccaatgagcagaaatgtccatcagcacacaggtcctggcctttatgtcatcagcagcccgctccatgtgtcgagctagcgtttgcagtacagcatcagacatgccacattcttgaactgtcatccgaataatgtgatcttcagaatgtttaaattcctttttttcctcctcatcttcaatggcttcatcttcactatcactgcaaattagagcttcaccacaactggtatcatagtaaatcctccgtcgaccaagtacagattggtcttctgtcatcctttggttcctgtccaaaaatatccatgttgtataaggtggaagctttggcacttctggtagtttaattggtctaataatagcattcttgggaccaagatttccaccaaacataacattagatgaagagaaaggactttcgtcttgaaaagtaccaccatctttgtcaaccggaataatatcaagactatgcagggtgcatagcgcatcatcttgcctttttgtgagcaaatttgatgctgaatcagtaccctttgatgtactaatttgcctattttttgataaattgtaagtcctctgtgtatagctgctgatattagtcttgttctcccctatcctattcttaatgtaagtcaaacgatctgcggtaatcctcttttttaacgagtcaataacagataaaacatagagggaggcagcattttcttctccagctcgcacagccgaattactggtgacctgggcggcgctgctagatgggcgagaccggcccgcggaagccgaggcagatgcggacgacgccactaccgccgcggcagcctctgcttccatcacccgtggaaaccctagccccgcgcgctctcccgccctcacacgcgaagtcgcttggaaaaaaaatgaacgaggatttggtgggggagggaggggtggggggagaagaggg

SEQ ID NO: 8997 - DNA, 2669 bp, Zea mays
ccacggttccacgaacgttggcgcgcaagctcgtggtgtgagcggtcactgtctcccatcccatggctccggcgctgagcgggactctgggcgcgtcgtcggtggcggcgctgcggccctgcgcggggaggagggcgccgtccgccgcgagctcggttgcgccgcgcgggagcggggtggtgaggtgctccagagggctcaggtgggacgcccacagaagcagggggaggttgctcagggtgaggtgcgatgcggccgtcgcggagaagcccgccgaggaggaggcggctggggagaagttcgagtaccaggcggaggtgagccgcttaatggacttgatcgtccatagtctgtacagtcataaggaggtatttctccgggagcttgttagcaatgcgagtgatgcgctggataagctgaggttcctcggcgtcactgattcttctttgcttgctgatggcggcgagctagaaataagaattaagcctgaccttgatgctggaacgattactatcactgacactggtgttggtatgactaaagatgagctcaaggactgccttggtaccattgctcagagtggcacctcaaaatttctgaaggccctcaaggaaaacaaagaccttggggcggacaatggtctaattggtcagtttggtgttggattttactcagcttttcttgttgcagagaaggttgtggtgtccaccaagagcccaaaatcagataaacagtatgtgtgggaagctgtggctgacagtagctcttatgtcataaaggaagagactgatcctgagaaaatgcttactcgtggaactcagattaccctgtttctaagacctgatgataagtacgagtttgcggacccttcaaggattcaaggcttagtaaaaaattactctcagtttgtgtctttccccatatacacatggcaggagaaatcaagaactgttgaggttgaagaggatgaagagccgaaagaagttgaagaggcaacgaagggtgagaaaaagaagaagactattacagagaaatattgggattgggaactagccaatgagacaaaacccatatggatgagaaatccaaaggaaattgagaacaccgaatacaatgagttctataagaagacattcaatgagtttttggaccctcttgcccacactcacttcacaactgagggtgaggtggaattcaggagtgttctttatgttccaggcatggcgcctcttagtaatgaggagataatgaaccccaagaccaaaaatatccggctatatgtcaaaagagtcttcatctctgatgactttgatggtgaactgtttccaagatacttgagctttgtgaaaggtgtggtggattcaaatgaccttcccctcaatgtttctcgggagattcttcaagaaagtcgaattgtaagaattatgcgcaagcgacttgtcagaaagacctttgatatgattgaagagattgcggaaaaggaagataaggaggactataagaagttttgggagagctttggcaagtttgtcaagcttggttgcatcgaggacacagggaatcacaagcgccttgctccattgttgcgcttccactcttctaaaaacgagggagatttgataagtcttgatcaatatgtagagagcatgcctgaaagtcaaaaggcaatctactacatcgctacagatagtctccagagtgcaaagactgctcctttcctggaaaagctggtccagaaagatattgaagttctctaccttattgagccgatagatgaggttgccattcagaacttgcagacctacaaagagaagaaatttgtggatatcagcaaagaggatctggaattgggtgatgaagaagaagagactaaagaaaccaaacaggagttcactctcctatgtgattgggttaaacaacagcttggcgacaaggttgcgaaggtccaaatatcaaagcgtttaagttcatctccatgtgttctcgtatctggcaagttcggttggtccgccaatatggaaaggctcatgaaggctcaaacacttggtgacacatcaagtttggaattcatgaggggaagaaggatctttgaaatcaaccctgaccacccaattatcaaggatttgagcgctgcttgcaaaaatgagcccgaaagcacagaagccaggagggctgttgagctcctatacgaggctgctttaatctcgagtggatatactccggagagtccagcggagttgggtggcaagatctatgagatgatggcgattgccctcggcgggagatggggaaggtccgacatggaggaggccgaagcgtcgacgggtgaggccagcgcagaggcagactcatctgaagtcaccgtagcagaggtgattgagccctcggaagttagacccgagagcgatccgtggagggaccagtgagttctcccacgggcatccttaactccatatttagcagtgccggggataaaaactaagccatgggcaagaacatattgccgtggcaatttttttgtaggcttagactttgccggccaccagaatcttattgaggaggtagtggccttagaaaagaataataaagcatgaagactgatgattacatagcgaaattgtgctgtccctctcaataatatttataatgaaaagaacttatttctgcag

SEQ ID NO: 8998 - DNA, 1475 bp, Zea mays
caaaagcaaccgtcgagcttgcaacgccttacgcctccacactcaacagtcatggtcgtcatgggcaaggagcagcaacacgaggaggaggaggtgcaagggaaggtcgtccaagaagaagtgcaagtcgtccaagagacggtggtgccggtgccgtcggaggaggacaaggaggccgaggcggcgctggtgcacaagatctccagcctggccgccgccatcgcgaagctgccatccctgagcccgtcgccggaggtgaacgcgctcttcaccgagctcgtgacggcgtgcatcccgcgcagcagcgtggacgtggagctgctgggcccggagctgcaggagatgcgcggcggcctgatccgcctctgcgccgacgcggaggcgctgctggaggcgcactactccgacctgctggcctccttcgacaacccgctggagcacctgtcgctcttcccctacatcaacaactacatcctgctgagccagctggagcacggcctgctggcgcggcacgtgccgggcccagcgccggcgcgcgtggccttcgtcggctccggcccgctcccgctgagctccctggtgctcgcggcgcgccaccttccgggcgcctccttcgacaactacgacatctgcggggaggccaacgaccgggcgcggcggctggtgcgcggcgacggcgcgctccaggcgcgcatggcgttccgcacctcggacgtggcggacgtgacccgggagctggcgtcgtacgacgccgtgttcctggcggcgctggtgggcatggcggccgaggagaaggcccgcgtggtggcgcacctcgggaggcacatggcccccggcgccgcgctggtggtgcggagcgcgcacggcgcgcgcgggttcctgtaccccgtggtggaccccggggagatccggcgcggcggattcgacgtgctcgccgtgcaccacccggagggggaggtgatcaactccgtgatcatcgcgcgcaagcccgttgccgtcgacgcgcacgccaccggcggggtggggcacgcgcacgcgcacggcgccgtgctcaaccggccctgcctctgctgcgagatggaggcccgggcgcaccagaagatggaggaggtggccgtcgagcagctgccgtcctaggcaggcgcacaccggcgtcctcgctttcttgtccgtccggccgcccatttgattttcggagttgcatatatctcatctaatatccatccatccatctatagcagtattatgtatgcatccacatggtaataatctggctgaccgcatccgcatatggtcgtctcatcgtccatctataccttgaaagctactaattaattactgagttattattaatactgtttttactactactacgtactattaatattactacaactacctcatctagctggtgtattaattgattttgtctgttactactgtactactgttgtttcaacggtcatatcatcatc

SEQ ID NO: 8999 - DNA, 1446 bp, Zea mays
cctaagtcctaactacctccacccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgtttcccacagggtagtcctcgcaccactgacgagacagcggtcctacggcaatgttcctcagcctcatgccatactgtactatcagcagagggcgactaaaggaggtcttctgatcgctgaggccacgggggtttcagacactgctcaagggtacgtctgtcgtctgctagaccatcaggctactacggctgcttgagatctgtgtggtcatgctaaatttcatcattcagtagtttagtcgatgtctgaataaagatgtgttttctgtatgcgcacaaggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcatgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatgggaatcgcgcgatctccactgggtatgctgatttggtcgcgttcgggcgcgtgttcttggctaatcctgacctgcctcggaggttcgaagtagacgctccccttaacaagtacaacagagacacgttttacatccctgatccggttattggatacctgactacccatttctttcgtcagatgtataaatgttctcttttcagcaatctgctttttagattgtgtagtaactggttggtgtaccagtaaaatattagacgaataaaccattggtctgaatgcctc

SEQ ID NO: 9000 - DNA, 2122 bp, Zea mays
ttttctcctctctgcttgctccagttccaagcaccaccgaatcagggcgagtgggagcagagggaaccccatgtctccgcccctcgctggagtagattctcggcgagccggcgtggagctgccgcggtagaaagccagctgagcctgcgagcgcctgatccgcccggagcccgatcgggatcgatgggtggggaggcgccggagccgcggcggctgacccgcgctctgagcatcggtggcggtggcggcggctgggttcccgatgagatgctgcaactggtgttggggtttgttgaggacccgcgcgaccgggaggccgcgtcgctggtgtgtcgccggtggcaccgcgtcgacgcgctctcgcggaagcacgtgacggtgcccttctgctacgccgtgtccccggcacgcctgctcgcgcggttcccgcggctcgagtcgctcgcggtgaaggggaagccccgcgcggccatgtacgggctcatacccgacgactggggcgcctacgcccgcccgtgggtcaccgagctcgccgcgccattcgagtgcctcaaggcgctccacctgcgacgcatggtcgtcacagacgacgacctcgccgagctcatccgtgccagggggcacatgctgcaggagctgaagctcgacaagtgcaccggcttctccacggatggactccgcctcgtcgcccgctcatgcagctcactgagaactttgtttttggaagaatgtcaaattaatgataaaggcagtgaatggatccgcgatcttgcagtcaactgtcctgttctggcgacattaaatttccacatgactgagcttgaagtgatgccagttgacctagagcttcttgcaaagagctgcaagtcactgatttccttgaagattggcgactgtgatctttcagatttgatagggttcttccaatctgccacatcactggaagaatttgctggagggacatttaatgggcaaggggaactcaccaagtatggggatgttaaatttccatcaagaatttgctccttgggacttactttcatgggagcaagtgaaatgcctattatatttccttttgctgctatactaaagaagctggatttgcagtacactttcctcaccaccgaagaccattgccagctcattgcaaaatgcccgaacttactagttctcgcggtgaggaatgtgattggggatagaggattaggtgttgttgcagatacgtgcaagaagctccaaaggctcagaattgagcgaggagacgatgaaggaggtgtgcaagaagagcagggaggggtctctcaagtgggcttgacagctatagcggtaggctgtcgtgaactggaatacatagctgcctatgtgtctgatataaccaatggggccttggaatctatcgggacattctgcaaaaaactctatgacttccggcttgttctgctcgatagagaagagaggataactgatttgccactggacaatggtgtccgagctttgttgaggggctgcaccatgcttcggaggtttgctctgtacttgagaccaggagggctctcagatgcaggtctcggctacattggacagtgcagtggaaacattcaatacatgcttctcggtaacgttggggaaaccgatgatggattgatcagtttcgcactgggatgtgtaaacctgcgaaagcttgagctcaggagctgttgcttcagcgagcgagctctggccctcgcaatactaagtatgccttccctgaggtacgtatgggttcagggctacaaagcgtctcaaacaggccgagacctgatgctcatggcgaggcccttctggaacatagagtttacacctcccagttcccagaatgctggtcggttgatagaagatggggaaccttgcgtagatagtcatgctcagatactggcatacggctctcttgctggtaagaggttggactgcccacaatccgtggtcactttgtatcctgcgtgagtgtaaatagactgagggcccgtttggtgcccatggaaccgttgtctggaacaatttctggtaggattgcttgctgatttgtataggctttgatcagctggaaacaaatgaacaaggcctaagctcgtgtctttctctc

SEQ ID NO: 9001 - DNA, 1778 bp, Zea mays
ccacgccttccattattagagtaccactactccattagtaccagcgtaccaccaccaccgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagatcatcagcgacgagctcatgctggacggcaacccgcgcctgaacctggcgtccttcgtcaccacgtggatggagcccgagtgcgacaagctcatcatggactccatcaacaagaactacgtcgacatggacgagtaccccgtcaccactgagctccagaaccgctgcgtaaacatgatagctcacctgttcaacgcgccgatcaaggaggacgagaccgctataggggtcggaacagtgggatcctcggaagcgatcatgcttgcaggtctagcgttcaagaggaaatggcagaacaagaggaaggagcaggggaaaccgtgtgacagacccaacatcgtcaccggtgccaacgttcaggtctgctgggagaagtttgcaaggtattttgaggtggagctgaaggaggttaagctatcagaagggtactacgtcatggaccccgtcaaggctgttgagatggtggacgagaacactatctgtgtcgcggcgatcttggggtcgactctcaccggagagttcgaggatgtcaagcagttgaacgaccttcttacagagaagaacaaggaaactgggtgggacgtgcctatccacgtcgacgccgcgagcggagggttcatagcgcctttcctctaccctgagctcgagtgggacttcaggctgcctctggtgaagagcatcaatgtcagcgggcacaagtacggcctcgtctaccctggtgttggctgggtcatctggcggagcaaggatgatctgcctgaggagctcatcttccatatcaactacctggggacggaccagcctacgttcacgctcaacttctccaaaggttcctgtcagatcattgcgcagtactatcaactcattcgcctaggcttcgaggggtacagaaacatcatggagaactgccaggagaacgcggcgatactgcgggagggcatcgcggcgacgggccggttcgacgtcctgtccaaggacgccggggtgccgctggtggccttctcgctcagggacagcagccggttcagcgtgttcgacgtctccgagaacctgcggcggttcggctggatcgtgccggcgtacacgatgccggccgacgcggagcacgtggcggtgctccgagtcgtcgtcagggaggacttcagccgcagcctcgccgaacggctggtctcggacgtccgcaagatcctgcgcgagctggacgcgcgcgcgacccacgccgtgagggtcgccaccgccaccgccgagcagtcgggcgacagcgtcgtggccaagaaaagcgtgctggagatcgagcgggaggtcgccgcgcgctggaggaacgccgtgaacaagaagaagacgggggtctgttgatgcgtcgtgggtcggagactgggaggtttcgccatggtagcttcgtctatatgtcgcgtgcttgtttgtgtctgtgcagggcgcttggatgcgttggtccagttccgcgtatgtgaacaaggtgtcgtatgcagtatgcaaatgttcaggatccaggaaccacaaataatggatgtaaatgttgggttt

SEQ ID NO: 9002 - DNA, 1527 bp, Zea mays
cgtgacttcccctccccttctcctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatcaacccagactctgcaaaaggctataaaactcgtggaatggcatatgccatgcttggcaaatgggaggaagctgctcatgatctgcacacagcatctaacatggattacgacgaggagatcaatgctgtgctcaagaaggtggagcctaatgctcacaagatagtggaacatcgcaggaagtatgagaggttgagaaaagagagggaggaaaagagagcgcagcgtgatcggcttcgtcaacgtgcagaggcgcaggctgcttacgacaaggccaagaggaaggagcaatcgtcaagtcgctcatcaggaggtgcatctcccagaggctttcctggagggatgcctggtggtggtttccctagagggatgcccggtggatgtttccccgggggcggcatgcctgggggtttccctgggggtggcatgcctggaggtttccctggtggtgttcccggtaatgttgatatgagtaaaatcctgaatgaccctgacctgatggcagcattcagtgacccagaggtcatggcggctttacaagatgtgatgaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgataaaaaaaaaaccaaacggctctatggtgatgtatgcaaaaagttgctttcgaacttgatttctc

SEQ ID NO: 9003 - DNA, 1124 bp, Zea mays
ggacggtgcttcctcttctttaccagctagtcaaagtaaccacgcgtgctgcttcatctctcccttccttcctgccgtgtggttgttggcagccgcagcggcggcgcccgcgggtggaggagcaggagaggcggcgccatggtcgggaccgggaagagggagcggatagcgatacggaggatcgacaacctggcggccaggcaggtgaccttctccaagaggcggcggggcctgttcaagaaggccgaggagctctccatcctctgcgacgccgaggtcggccttgtcgtcttctccgccaccggcaaactcttccacttcgccagctccagcatgaagcaggtaatcgatcggtacgactctcattccaagactctccagaggtccgaaccgcagtcgtctcaactgcagtcacatatggatgacggcacttgtgcaaggctaaaggaggaacttgctgaaacaagccttaagctcaggcagatgagaggagaggagctccagaggctgagcgtcgaacagctgcaggagctcgagaagaccctcgaatccggcctcggctctgtactcaaaaccaagagccaaaaaaatccttgacgagatcagcggtctggaaagaaagagaacgcagctgatcgaggagaactcaaggctgaaggagcaagtgacacggatgtcgaggatggagacgcagcttggcgccgatccagagttcgtgtacgaggaagggcagtcgtctgaatccgtgacgaacacgtcctatccgcgcccgtccaccgacaccgacgactgctccgacacatcgctcaggctcgggctaccactcttcagctccaagtgacggagatttgacatgtccggtagcggagcggtgccgattgcttgcccttctccactctagataggtctggattgggggagagcaagcactgctggatcgggaagacccaagtgaccaacgcgtcgcatcagaataaggcattttgagtgctgtatgatgtgtgtattctggctctgaaagtgagacctgcttttgttataatacatacatacaggcagcatggcaatacgtgacggggtatccgctgcctgcagtccgtgacctgtctgtcgtctctgtttct

SEQ ID NO: 9004 - DNA, 1295 bp, Zea mays
gcgaaaccgacgtgctcccgggcgggcggcgacagcggcatggagcgagagcggcaggcagtggcgaggaacaggaaggtggtgctgcgcgggtacatcgaccgcgcgcccagggaggaagacatggagctcgtcgacggcggcgccgtggagctgcgcgtccccgagggcggcggcggccccgcggtgctggtgaagaacctctacctatcctgcgacccttacatgcgcggcaggatgcgggacttccgcaactcctacatcccgcccttcaaacctggatcagtgagcttccctcgtttcccttttcatttttttggggagcttgcccgcttggactcttttggttagctgctgaagctgcaggctgcaaagtcgggtgggcgattcgtgcgctgattgagcaattccttgatctgtgaagcctattgaagggtttggcgtggggagggtggtcgactccactcatccaggattcagtgccggtgacgttgtttccgggatgactggatgggaggactacagtctgatcaccaatcctgaacagctcaggaagatccagcaaagcgacataccactctcctatcatctgggccttcttggcatgcctggctttacagcttatgttggattctatgagatctgttcaccaaagaaaggggagtttgtttttgtttctgctgcatcgggagcagttgggcaaattgttggtcaacttgcgaagctccatggttgctatgttgttggaagcgctgggacagatcagaaggttgagctcttaaaggaaaaattcggatttgatgcggctttcaattataaggaagagcctgacttgactgctgccctgaaaaggcacttccctgaaggcatagacatctacttcgagaacgtaggcgggccgatgcttgatgctgtactactcaacatgcgagtacatggccgcattgcggtgtgtggcatggtttcccagcacggggtgactgcccctgccgggatccacaacctgttctccttgataagcaagaggatagcgatgaaggggttcatccagagcgattacgtgcacctgttcccgcagttcgtcgatgacatcaccaggcattacagagacgggaagatcgtgtatgtggaagacatgagcgttgggctggagagtgggccggcttccttcgtcggtctgttcagcggtaaaaatgttggcaagcaggtcgtctgtgtgtcgcgggattgaaaggcctggattttgttccctactggccagtacccttaaataaaatcaggaaaacattattttc

SEQ ID NO: 9005 - DNA, 1775 bp, Zea mays
cccaattccatttctccatccatgacagctcgccatttccccacctgttcctacgctaccgccacctaaaaaaaattccaggcactatccatttcaatcttgctcaaaggtcatttcatttcggccggtacctattttaggccgattggagggaaggctggtctgtgttttattttcctgctgcgagcgctttcttgggcgagttgaatttgggcgcctcttgctccaggcagtatttttatcgagctagaatctggtacccggtgattcttgcttggtccaggcgccaaggcgaggaattgggcctagccccagctcaaatctgtgccttgttgcagacagaaggatttctgcatgggcgaccataactaagatgtgagatttggtggcgtcagctcggccggtgggtgattcttggtgcgtacacagacacatccctggaggcctggaggcttggcgaggaggacagtgcaggagagagatgtctttcaggagcctgattcaggacatgaaggacgagttcgggagcatctcgcggcacagcctgcggtcccggtctcaccgctccgccgggaacgcggcgcgggcggtggccgcgggaccgtcggaggcgatggatcagagctgctggtcgcagctgccccccgagctcctgcgggaggtgctggtgagaatcgaggcatcggagagctggtggccagcgcgcaaggacgtggtgtcaggcgccggcgtctgccggacctggaggggcatcatgaaggaggccgtgcgcgtcccggaggtgtcagggaagctcacgttccccatctcgcttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccgtccctgcatcagctgttaaggaaggagggaaaactcctacacagactgaatttccacttagcagccttgactctttcccatcatttccattcttcagatctaaatcagctcggatagacagttcaacgtcgcaatcatccagtcagagggaagataggttggtgctgaagaacaagtctcctaggtggcacgaacaactgcagtgttggtgcctgaatttccgtgggcgggtcactgttgcctcggttaaaaacttccagttggtggcttctgaggacaatggaccagagagccaagagagtgacaaggtgattctccaattcggaaagatcggaaaagatttgttcaccatggactacggttatccaatatcggcatttcaagcttttgcaatttgtctgagcagttttgatacaaaaattgcctgcgaatgaggcaaggtgatttccccccttctctattccccttgcttgtattatggacatgcagtaaaattttattgaacatgcaatttccaatgtc

SEQ ID NO: 9006 - DNA, 1072 bp, Zea mays
ttttctccagctggagagccattcgtgggcgtaggacgagagagagaggatcggagcagtacgcggcggcggcggcgtgtgggagatggcgcgcgagaggcgggagatacggcggatagagagcgcggcggcgcggcaggtgaccttctccaagcgccggcgcgggctgttcaagaaggcggaggagctcgccgtgctgtgcgacgccgacgtcgcgctcgtcgtgttctccgccaccggcaggctctcgcagttcgcgagctccagtgtgaatgacatcgttgacaagtacagtacacattctaagaatctggggaaatcacatcagcagccttctattgatttgaatgtagagcagagcaaatacagcggcttgaacgagcaacttgctgaagaaactaatggacttagacagatgagaggtgaagaccttgagggattgagtgtagaggaattgcaccgaatggaaaggaaacttgaagcaggactgcatagagtgattagtacaaagctattcatgcaacaaatcggcgaattactgcaaaagggcacacagctagaagatgagaacaggcgtctaaaagaacaaatgcctcaggtgctaacggctggcacaatggtggttgctgctgctgcagaaaatatcctcactgaagacgggcagtcgtctgaatctgtaatgactgcattgcattcaggaagctcgctcgactgtgatgatggttccgatatatccttgaagttgtcgttgccttgaaaggaaggaccatcgcatcgcatgttatctgcatgagtggggctgacaccagtgcttctaagaagacaaagactgggatagtcccattcgcggcattatattggtttaaccagatgtgctgtccttgtgcatgtctgtacctcaaagtggctaacgcgaaatttgtatatataatagtgtatgcgctgcgttatcttcgttctaaaaatctgtattgtttcgttgctggtgctatatttgttggtgtattatatatatgcacttaactgttatctctattctattaagaacataatatagacacatgatgctacc

SEQ ID NO: 9007 - DNA, 1130 bp, Zea mays
ttgtactgagctgagctgccggaggcagaataggagaggcaggcgatgacgatggcgacgaaggcggcgtgcgtgctggcggtgtgggtgctcgtcgcatcgggcctgtccgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagcctctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctacttcaagtataacgttacggaaatgctgtcaagtggatggatacaggtttcaaatggtaaggaatatgcactgagcgatgtcatcgataccatcaaacatgcttttgggggatcaccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccgacgtatgatccccttgtgcttgccaattcaactgtagagatcatgacacagttcgatgaatttgaggtgcctgcagctctttatacagcctaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggatattgcacatgtaattcgctaaatcaaaactgtatcttgaggtagaattttcaagtagtaataatagagatataagaaacttatcgccc

SEQ ID NO: 9008 - DNA, 1849 bp, Zea mays
ctccttcaccgtccgtccattcctccgatccgcaggaggattaggaacttaggatcggggaccggcggagcccgacgaccttctcggtccacccgcccggcgatcgaaccacggcgctcggcgagggcggggatcacggcgccgccctgcccctcatcgcggaccaggcgaaacatgccgccgccggtggcatcgtccgaagcgggagcatgtggacggcagcggcacacgtgatcacggcggtgatcgggtccggcgtgctgtcgctggcgtggagcatcgcgcagctggggtgggtggccgggccggccgccatgctcgtcttcgcggccgtgacggcgctccagtccacgctcttcgccgactgctaccggtcgccggaccccgagcacggccctcaccgcaaccgcacctacgccaaagccgtggaccgcaacctaggtagcagcagctcgtgggtgtgcatgcttctgcagcacacggccctgttcggctatggcatcgcctacaccatcacggcctccatcagctgcaggcaagaagcatacctgggcttgcggctcgctgcagtacgtgagcctgtacggctgcggcgccgcctaccatcaccaccgccactagcataagggcgatcctgaaggcgaactgctaccacgagcatgggcatgacgcgcactgcgactacgatggcaactactacatgctcatcttcggcggcgtccagctcctcctctccttcatacctgacttccacgacatggcgtggctctccgtcgtcgccgcggccatgtcgttctcgtacgccttcatcggcctcggcctcggcctcgcaagaaccattgctaacgggacgatcaaaggaagcataacaggtgttcggatgaggacgcctatgcagaaggtttggcgcgtctcgcaggccatcggcgacattgccttcgcgtacccctactctttgatcctcctggaaatacaggacaccctgaagtcaccgccggccgagaacaagacgatgaagagggcgtcgatgatctcgatccttgtcacgacattcttctacctctgctgcggctgcttgggctacgccgccttcggcagcgacgcgccgggcaacctccttaccggcttcggcttgtacggtccgtactggctcatcgacttcgccaacgcgtgcatcatcctccacctgctgggcgggtaccaggtgtacagccagccgatattccagttcgcggagcggctcttggcggagcggttcccggacagcgggttcgtgaacggcggctcctacaccgtccggttcgcgtgcctgcgagcgtgccgggtggacccgctgcgcgtgtgcctccggacgctgtacgtggcctccacgacggcggtggccgtggcgttaccctacttcaacgaggtgctggcgctgctgggcgcgctcagcttctggccgctggccatctacttccccgtggagatgtacttcatccagcggaacgtgcgccggtggtccgcccgctgggtcgtcctgcagaccttcagcgtcgtctgcctgctcgtcagcgccttcgcgctcgtcggctccatcgaggggctaatcagcaagaagctaggctaggctagtccgatccagtggaacaccctatctgcaggtctgtcagagagtggcagcgggctcggttattttcacagtgttgccttcctcctgcatcgggttgtaagttgtaagatatatgtcgtattgatactggcgagttcagatgttcagaagaagtagaacgcgtgtgacgattctgtgttgctgaatgccgcctatgtagtttcagttccagaatttgagggtttccatattcgcagc

SEQ ID NO: 9009 - DNA, 821 bp, Zea mays
agcacgggggcttgatcgaagatggatgccggagcaaaggtggtgaagaaggccgcggcggggcgtcgcggcgggggcggccccaagaagaagccggtctctcgctccgtgaaggccggcctccagttccccgtaggccgtatcggccgctacctcaagcagggtcgctactcccagcgtgtcggcaccggcgcccccgtctacctcgctgccgtcctcgagtacctcgccgccgggctcctcgagttggcggggaacgcagcgcgggacaacaagaagaaccggatcatcccgcggcacgtactgctggcgatccgcaacgacgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctagctgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcattaggtgctgtttgtaataagattgcaaagatgtgtaaaatttgttttgtgcttccattc

SEQ ID NO: 9010 - DNA, 1048 bp, Zea mays
ctccagtcggtcgaggagtagggttctagcgcctatctccctgcgccgccgccgtggacaaccggagcgtagtgggaggggatgatggagggaggtagccgcgcggatgggcggaatccgaaccagctccggccgttcacctgcaccgggaacccgctccaccgcgcccacggctccgcgcggtgggcgcagggcgacaccgtcgtgctggccgctgtgtacgggcccaagccgggaacccggaagggcgagaaccccgagaaggcctccatcgaggtcgtgtggaagcccaagaccggccagatcggaaggcaagaaagggaatatgagatgacactcaagaggacgttgcagagcatctgcttgctcacagttcatcctaacaccaccacctctgtcgtgcttcaggttgtgggtgatgatggttctcttatgtcatgtgcaattaatgcttcttgtgctgctcttgcatttgctggaatccctatgaaacatctcgctgtcgcgattagctgtggagtgatggacaatggtgtggttatcttagacactagcagagcagaagagcagcaagctaggtcgtttgctcacctggtgtttccgaactcgcgcaagtcagtcgaatcgaaggacacgacacagcgagatgaggagtccgagcgaggattgataacttgcatcacgcatggggcaatgtccgaggatgactatttcaactgcatagagaggggtgtcatggcgtcctcgaggatctcggatttcatgaggaagacactgcagaaggaggcttccagggatgcctgacctgagtagcaaatgtattagcacgactgagaagctgcctgcctgtgataggcgatggcgatggcaatggtgtgtagacagcagctgggtctctagttttgacggcatgtagtcgtgttagaatgaaggaggcaagggtgcggtggagtggatgtcaatcggcgtgtgatgccatgtctcaattgtgcggtggagtggtttggtggacttttgatgaacagataatgaggttgtatttggtggt

SEQ ID NO: 9011 - DNA, 1239 bp, Zea mays
atcccaaatggcgactgcagcttcgcccgccgctgcctttccccacatcctctccctctcctcctaatctcctcccaatccccctctctctctctcttcctcgccagctggttcgttccgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcggatatacctcgtcttcgagtacctggatctggacctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcggcgtaataatgcgctgaagcttgcagactttggtttagccagggcatttggaattcctgtccgtacatttactcatgaggtagtgacattatggtacagagctccagaaatccttcttggagcgagacagtattccacaccagttgacgtatggtctgtgggctgtatctttgcggaaatggtgaaccaaaagccactattccctggtgattctgagatcgacgaactgttcaagatattcagggtgctaggtacaccgaatgaacaaggttggcctggagtcagttgtttgcctgacttcaagactgctttccccaggtggcaagctcaggacctggcaacaatagtcccaaatctagaacctgctggcttggaccttctctctaaaatgcttcggtatgagccaagcaaaagaatcacagctaggcaagcacttgagcacgagtacttcaaggaccttgagatggtacagtgacctgctaaatgtgcttggcgctgctttggcatttgtaattgtatgagctgagtcgctcattcctttttatgggcgtctgtactctctcattctctctgcatttttgtcgttcagctggatattttgaatctggtgtgttttgagatgtattaaggaatatcaaatagattaccgccttggtctctatttactgaaagt

SEQ ID NO: 9012 - DNA, 1738 bp, Zea mays
gccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctc

SEQ ID NO: 9013 - DNA, 1246 bp, Zea mays
gtctgtgttcgtggagcaggggccggcgccatggagatcaacatcgtagacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaagaatttcctgtatcagttatgcaaaggagttgcacactgccatagccatggtgtccttcaccgggatttaaagccacaaaacctgctggtggacaaggagaagggtatactgaagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttgctgaaatggcccgacggcaggctctctttcctggtgactcggagttgcaacagttgcttcacatcttcaggttgctgggaacacctactgaggaacagtggcctggagtgagtgatttaagggactggcatgagtttccacagtggaagccccagggtttggcacgtgtcgtcccaacactggaacctgaaggagttgaccttctatcgaaaatgcttcagcttgatccttcaaacaggatatcagctttagctgcgatggagcatccctactttaacagccttgacaagtcccagttctagccgttgtactatgtggttcagaaggcgctaccctcgtacagagagatttccaatggtgttatgaatctcaattgccatctaggcaactggttcatgattttaccaatctgttagtgagtgaaaatcgtgcgagggtcatatgtgttccccttgtcttaaaaatctggtgtggtgtagaacaagagttacctgtgggaggcctgtgataatgccctttatgtctcaacatccattttcgtgcattccatgttcttcaatacggacttgaaacaggaattctgattttctt

SEQ ID NO: 9014 - DNA, 762 bp, Zea mays; identical to SEQ ID NO: 2266

SEQ ID NO: 9015 - DNA, 827 bp, Zea mays; identical to SEQ ID NO: 2008

SEQ ID NO: 9016 - DNA, 834 bp, Zea mays
caatctttcgccctcttcgcgcagcagctacagagctagggttccgtcctcgatccgatccggcgagtgctcaccacctttccccacttccctccgatcgaatcgatggcggccgagggcgaaaagaaaatgataaccctcaaaagctcagatggtgaggagttcgaggtggaggaggcggtggcgatggagtcgcagaccatccgccacatgatcgaagatgactgcgccgacaacggcatcccgctccctaacgtcaactccaagatcctatccaaggtaatcgagtactgcaacaagcacgtacatgccgccgctgccgctgccgcagcctccaaggccggttccgacgacgtgggtgccgccgccgccaacagcaccgccgcctccggtgaggacctcaagaattgggatgctgacttcgtcaaggtcgaccaggccacgctcttcgacctcatcttggctgcaaactatctcaacatcaagggtctgctggacctgacctgccagactgttgctgacatgatcaagggcaaaaccccagaggagatccgcaagaccttcaacatcaagaatgacttcacccctgaggaggaagaggagatccgcagggagaaccagtgggcctttgagtaaggaggtgctgagccctctgatctcttatgcctaggtttcgtcatatctactaccttgcaatgctctgcttttaaatgtcatcgtaatggttgtaagtattttgggagtcactttgcttgagaatgtgttgggtaaaactgatgtggtcaatggtcggttattactatgaaaggacatcggctgctgccctaagaggtc

SEQ ID NO: 9017 - DNA, 1774 bp, Zea mays; identical to SEQ ID NO: 1175

SEQ ID NO: 9018 - DNA, 708 bp, Zea mays; identical to SEQ ID NO: 2218

SEQ ID NO: 9019 - DNA, 996 bp, Zea mays
tctccgacccgatccgacccgacacacaaatatctccacccctgttccggcgacgactacgatttgggaggaaggtaagcgaatgggtgaggaggcggtcgacgactacgagctccacatggtgtgctacggcggcggcggcggcggcagcgaggacgagcgcgtgatggagtgggagtcaggtctcccgggcgcggacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagataagtttcttttccc

SEQ ID NO: 9020 - DNA, 848 bp, Zea mays
cagtcttccccaagtcgtctaaaccccaatccctaaatccccgacgcagaccacacgacgcgcacctccgttcacgaggcggaagcatgagtcgccatccgatcactaagtgggcacagaggtccgacagggtgttcttgacaatagagctgcccgacgccaaggatgtgaagcttaacttgaagtctgaaggccatttcaacttctcagctaagggctcagatgacttgccctatgagtttgacattgagctgtttgatgctgtgaatgtggaggagagcaaagcagctgttgccccaaggaccatatgctacctgataaagaaagctaagagcgggtggtggccaaggctgctgaagcaggagggcaagccacctgtgttcttgaaggttgactgggacaaatggcaggacgaggatgatgaagatgctggatttaatgactttggtggtatggacttctcgaaactggacataggaggtgctgatgacgacgatatcggggatgatgaagatgatgtggttgaaagtgctaacaaagatgaagaaggaggtaagacagaagagagcaaggaggaggaagcagctcctgcggctgcagaggaagtgaagccatgaagaatcatttgactttgctccgcgccatgggtgtccacggtatctagctaggctagacgttcccttggatttttggtgtaaaatctggaggtcgaaccactcactgcctattgaagtaaaggatacaaaaacagttgtgctgtcttagtttttggctgaaccctgtgaactgctgctacaatatttggtcagagtttatatgcatccatcatgcgacgcagcttgtggtgt

SEQ ID NO: 9021 - DNA, 624 bp, Zea mays
accatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgcc

SEQ ID NO: 9022 - DNA, 1604 bp, Zea mays
tcaccgcaagcgtgcgcgcaacccagctcccaccgacgactgcaccggccgtcgctgccgcgctacttcggccccttttccggcgacgagcaccaccaggtccatgcagagtaggaaggcaccttttcgtcactcgaacctgttgcttgacctgcaagtgtcgggcggtgcacctgtgcccttgttgccgcgatgcagattatgtgggttttgagttggacagctgatggagtgcaaatctctggcctgccaggtagctgctaatggagattgacagcctcagagaaggatttgatcgagttgctgagaaacgttcattatcttctgctaaagctctggaagttgttgatcaaatagtgaatgaaattgagcaggctattgtgaagctgcagatgatgaatacagattctactggaaatgttgaccacccatccatccttgcagaactgaaagctaagctcaatgaaatggcaccactaaaccagcttgaaggcagccaaaaggagctcaatgttgctctgagcaaatatctcaaactccttgagaagtctttcaatccagatatatctaaggcatacagaaatgtggattttgaggtccatacagtaaacaatatcatagcgaatcatttctaccgccaaggcctctttgatcttggtgacatgtttgtccatgagtgtggggaactaggcggagcttccttgaagctaccgtttcaggagatgtatgctatccttgaagccatgaaagcgagaaacctcgagcctgctctcagttgggctgccaaaaaccatgatcagctgttgcagaatgggtctatgctggagttcaagctttatcagcttcagtttgttgaaatattgtccaaaggcagtaggggtgaggccaaagatgaggctcttttatatgctaggactcacttggtcccctttgcagccgtgcacaaggaagaattccagaagctaatggcttgccttctatgggttggccggctcgatcaatccccatattctgagttaatgtcatccgcgcattgggagaagctagctgaggagctcacccatcaattctgtagccttctgggccagtcgagggagagcccgctgagtgttgcagtgtcagctggttttcaaggactaccaactctgctgaagctgacgcaagtcatggctgcgaagaagcaggagtggcaagttatgaagcagcttcctgtccccatagacatcgggccagaattccagtatcattctgtctttgtgtgcccggtgctcagggagcagtccagtgacgagaatcccccaatgcggatgccttgtggacatgttgtctccaagcagtccatcatgaagctgtcgaaaagcagctcgagggccttcaagtgcccctactgcccctcggaggctatggcgtcgcattgcaagcagctgcatttctagatgtgttaatcttttctggctgcgcaaaactgcaaacctgttggtacatgtttcccctcctgttccatgttgcaccagtccaataactgtctctctgtaatataaacatctacgtccggataaacatgtagtttcgtctgtattactgatatgtacagttgcatcttt

SEQ ID NO: 9023 - DNA, 565 bp, Zea mays
tcgaaggggaccgcatattcgggatccgatccttcagcgtccggttagggcaaaagaaggtcttttggatctgcgttggcttgcttgagatggcctacagcgttgcgatactgatgggagctacctcttcctgtttgtggagcaaaacagcaaccatcgctggccattccatacttgccgcgatcctatggagctgcgcgcgatcggtggacttgacgagcaaagccgcaataacgtccttctacatgttcatctggaagctgttctacgcggagtacctgctcatccctctggtgcggtgagcgcgaggcgaggtggtggcagacggatcggcgtcggcggggcggcaaacaactccacgggagaacttgagtgccggaagtaaactcccgtttgaaagttgaagcgtgcaccaccggcaccgggcagagagagacacggtggctggatggatacggatggcccccccaataaattcccccgtgcatggtaccccacgctgcttgatgatatcccatgtgtccgggtgaccggacctgatcgtctctagagagattggttgcac

SEQ ID NO: 9024 - DNA, 1614 bp, Glycine max
actacacaagaactagctataggcctcaattagttattatattaatttggtctaagtagttgttattacttgtgtagtagttcttctccaatggctgatttaggttcagcctcttccaagagaatgtggtgttccgttccagaaagaatgcagcttcacttggccatgttggccttgcagtttggctatgctggattccatgttgtctcaagagctgcacttaacatgggcgttagcaagcttgttttcccagtctatcggaacatcattgccttgcttctgctccttccctttgcctacttcttggaaaagaaggataggccagccatgactttaaacttcgtctgccagttctttcttctggcacttgtcgggattacagcaaaccaaggtttctacttgctagggttggagaacacatcccctaccttcgcatcagcaatacagaactcagtcccagccattacatttctcatggcagccatattaagaatagagcaagtgagattgaaccgaaaagatgggttgggtaaggtggcgggaacagtgctatgtgtggttggagccaccgtgatcacactatacaaaggtccaacaatatatagcccaacaactggtgtgaacataaacaacacaagagtgacacaagtgtttgaattggggtcagtgtcactgggagatgcaaaggggaagaactggaccctagggtgcttatacctcattggacactgcttgtcgtggtctggttggcttgtgttgcaagcaccggttctcaagaagtacccggctcgcctctctgtcacttcctacacctgtttctttggactcttgcagtttctcgtcattgctttgctccttgaaagagacgcgcaggcatggcttttccactctggtggagaagctttcactattttatacgcgggagtggtggcatctggaattgccttcgctgtacaaatatggtgcattgacagaggtggtcctgtgtttgttgccgtctatcaacctgttcagacttttgttgtcgccatcatggcttccattgctttaggagaagagttttacttgggcgggatcattggtgccgtgttgattgtagcgggactgtaccttgtcttgtggggtaagagtgaagagaggaagtttgcaagggagcagcttgcgattgcatccactgagcatagcatcataaggcccgcaagccacgccaaagcatcacttgctcagccactcctttcttcatcaacagagaatgtttgaacaagatcaaaattccaacttcaaaccacacaccattttcttggtgagaagaagtaaaagaaaaaaggggaaaaaagataccagctataccttactagttactactgctactactacattatgtcagcaagtttgtgtgtgttggaaccggttttcatcttttcctttctttttttttttatttaattcaaatgcttttttagtaggtcatttagaatatgagagaattgtgggaatggttgtaatggtggatgccactttaagtggggctagagcctgaaatccccccatatgcttttgtatgtcaattaatttatggtttgatttaagaaatgaatttttgttttttgggtc

SEQ ID NO: 9025 - DNA, 1416 bp, Glycine max
tacaagttaacgagttatgggagctccccggacctcagttttaaaggggctttagggcgttaaaaagaaagcgcagagaaaggtgttgttctcagatccatccatcagtggtgggcgatgttgttgttctcagatccagactgagggggtgaaggaaaatgaagtcgtcgaggcgtctgttgaggatcgggcttgtgtcggcgtggtactcgtcgaacattggggtgctgctcctgaacaagtacctccttagcaactatggcttcaagtaccctatcttcctcaccatgtgtcacatgaccgcttgctccctcttcagctacgtcgccatcgcctggctcaagatggtccccatgcagaccatccgctcccgcctccagttcctcaagatcgccgccctcagcctcatcttctgcttctccgtcgtcttcggcaacgtctctctccgctacctccccgtctcttttaaccaggccgtcggcgccaccactcccttcttcaccgccgttttcgcttacgtcatgaccttcaagcgcgaggcctggctcacctatctcaccctcgtccccgtcgtcaccggcgtcgtcattgccagcgggggtgagccgagcttccatttatttgggttcatagtatgcattgcagctactgccgcacgtgccttaaaatccgtgttacaaggaattttgctttcttctgaaggagagaagttgaattctatgaaccttcttctttacatggctccaattgctgttgttttccttcttcctgctacacttataatggaagaaaacgtggttggcattacattggctcttgccagagatgatgtgaagatcatttggtatctgctatttaattcagcacttgcttattttgtcaacctgaccaattttttggtcaccaaacataccagtgctcttacccttcaggtgcttgggaatgctaaaggggccgtagcagtagtagtttcaattctgatatttagaaacccagtgtcagtcactggaatgatgggttattcactcacagtcctcggagttgtactttatagtcaagccaaaaagcgaagcaagtgatactgatgctgtctgtcattcatgattctgtggaaatcagcagtgaattccctatatttgttttcattcctgtgcggacaaactcaagattccatgaggcaaatttgttagcatgattgtgatcagaatgtttcagactctacaattttttggccctacatggaaaaacgggtttcccattgtattagtacctgtgcagaaatagcccacagtacaaagtttcaataagtgactgatctctctactatacccatgttggcatataatcgaggaatgtctttttgtcatttattctttgaagaaagagttgtagaaggacctctactcatttgttgtt

SEQ ID NO: 9026 - DNA, 1837 bp, Glycine max
gaaacagagactgagagaaacaaaactgattgcgtggctctatagtggttttgttcttatttccacaaattgtcatttcttccttttaacaagttcgtaaaagaaactcactcacctacacatacagacagaccccatcaataatctgaacataaagtttcgttttttgtgaagattttggaggaagagggtggtggttgagtttaattcaaggtcttgcaatggcacccagttttgactttgcttctagcctcctttgcacagaggacagcaccgttttcgacgagagtcataataatgggggtacgatgatgacggcgatgggggtgtacgaggacacgaggagtcctaggaggcgccactttgacgaagaaccagatgagttgccattgctaagtgatgagagcttggtgatgatggtggaaaaagagtgccaacactggtctggtctgcgttacttgaataagtttcaaactggggatttggacttcggtgccagaatggaggccattgattggattcacaaggtccgatcgcattttggatttggtcctctctgtggatatctatctataaattacttggaccgattcctctttgcatatgaattaccgaagggaagagtttggacaatgcaattgttggctgtggcgtgtttatctctagcagccaaattagatgagacagaagttccactctctcttgatttgcaggtgggtgaatcgaagtttttatttgaggctaaaaccatacagagaatggagcttcttgtactaagcacattgaagtggagaatgcaagcaattactcctttcaccttccttgattactttctttgtaagatcaacgatgatcaaagtccattaaggtcttcaattatgcgatccatccaacttatatcgagcactgcaagagggattgacttcttggaatttaaaccatcagagattgcagcagcagtggctatgtatgtcatgggggaaacccaaacagttgacactgggaaagcaatttctgttctgattcaacacgtagaaaaggagagactattgaagtgtgttcaaatgatccaagagttatcatgcaacagtggctctgccaaggattcaagtgcttctgtcacttgcttaccccagagcccaattggtgtgttggatgctttgtgcttcaactacaaaagtgatgacacaaatgctagttcatgtgttaattcttcacacaatagtcctgttgccaaaaggaggaagttaaacaaaacctgtggagctgagcaattgtagtgatgttggagtgggaattttacaatcatccataggatgcttttccaaaaaaatgggcatcatgtgtgttttatggaaggtgctcccctcaaagcaataccaaaatgaggcaggaagacatagctagaaatcttttatttttttaatttctcaaaaagaaaaaagaaaaaaagaccttagtgtaaaaaatacaaaaaactatattaaggtgaggtggatcatgagtggaagatgggtgatcaagcgaacagtgcaatacattgcattctattggcatgaagtgagtaatcaccagctgttaaatattttagatctattaacagcagctagagaacaaaggatctgaagaagagggataaggattattagagtattgtatgtgtaggtaaagttgggggggagtttttcatttgttcaattttttacttttaaaatgggagagagaaaaatagactgaagaaaaaaaagagatagctatatatatgcgggaaatattttatttatgttattatttttattctgttagttatttttacttaatcagattttaaaaaaaa

SEQ ID NO: 9027 - DNA, 1576 bp, Glycine max
agcaaattgggcgttctcatggctccactgcttgtcgagttgtgagtatttggccacacggaaagatcaggctttgctttgctttgtgtgagatctgaagaagagaggtatggcaaaaagggtcttcttgtacaaggatttggttccttttggggccatggtgaccatggaatgcctcaacgtagccttgaatactctgttcaaagcagctaccttgagagggatgagttaccatgtctttgttgtttatgcttatgctgttgctgctattgttctcattcctggaccctttatctcccaaaggtgcagatcaagagtgcttcctccgctcagtttccccctactacgcaaaattggtcttctcgggctaataggatcgtgggatacacaggcatcagtttcagttcccccactctctcctcggcgataagcaacttggtgcccgcttttacttttttgcttgccatcattttcaggatggaaaaggtgattgtaagaaatacaacttgtcaagccaaggtattgggtaccatagtatcaataactggagcattcgtagtgaccttctacaaaggaccaccaatcatcattgttcatacaccttccttgtcacttcatcaaccaattaacactctgaattcggtagatcgaagttgggcaattggtggccttctactgacagcagagtatattctggttccattatggtacattgtacaggtgcaaatcatgaaggtgtaccccaatgaactaactgtgatcttcttttacaatttatgtgtaagcatcatggctgcaattgtagctatatttacagagacaaatgcaggagcttggaaaataggactagatacagcattggcttcaatagtttgctctggaatttttggttcatttgtgaacaacgcagttcacacatgggtactacgtataaagggtcctgtctatgtggcaatgttcaagccactctcaattgccatagctgttgccttgggagtcatgttcctgggtgatacactccaccttggaagtctagtgggagccacagtaatatcgatcggattttatacagtaatgtggggaaaagcaaccgaagagaatgtggacgaagatgtccctggccagcaatcaccaccaaccacagagaatgttcctctcttgcaaagctataaaactgatacagctgaaaagaaaatgcatggaagtgtataaatgacaaacaaaactgttgataaatcttaacattattgaaattacacgaatagcaaagcaaatacatggttttgttttcgcccaagctaaccctgtaacgccaatagcaattagcaaagtaggtacccacgcctttagagtgtagaggacatcatatgtaagaaatagttcaagggttcaactgatctcctttcgccaaggaacataaacgaatctttatacaaattagggagcaacctatctacaagtttgtgtacgaacactcacagatgaaaacggagcaacttcgttatctgtcttcccttttcctgtctcttgtaacaagtcatccatattatgatttatagaagctgcgtgattcttt

SEQ ID NO: 9028 - DNA, 836 bp, Zea mays; identical to SEQ ID NO: 8612

SEQ ID NO: 9029 - DNA, 643 bp, Brassica napus
ttctggggaccatctattctgttccaccatttagaatgaagagatttccagttgcagcgtttcttattattgccacggtacgaggttttcttcttaattttggtgtgtaccatgctactagagctgctcttggactttcgtttcagtggagtgcacctgtggctttcatcacgtcttttgtgacactgtttgcactagtcattgctattacaaaagatcttcctgatgttgaaggagatcgcaagttccaaatatcaacactagcaacaaagcttggagtgaggaacattgcattcctcggttctggacttctgctagtgaactatatttctgccatatcactagctttctacatgcctcaggtttttagaggtagcttgatgattcctgcacatatgatcttggcttcatgcttggttttccagacatgggtgctagaaaaagcaaactacacaaaggaagctatagcaggatattaccggtttatatggaatctcttctacgcagagtatctgttattccccttcttctagcattcatggtgaacatttgtagttttctttgtatacctctcttcttcttctttgtagcttggagacaaaatcactttgttcatgtacatactaaaggattggtctttttg

SEQ ID NO: 9030 - DNA, 1492 bp, Glycine max
ctttaatttgtctcttacttcacgcaagttgttcacggctcctctttatatgtacacgtactatctctcatgcatttcattcatcacatacaacactctctccaaagttcaaattaagactgagaggtgagaaagagagaattcatatgggtgccggtctagttgcgttcctcttaatggttcttgtgcaattggtctatgcagtgatgaacattacttcaaagcttgcaatagaatctggaatgagccctcttgtccttgttgcttatcgacaactctttgctactgtgtccattgctccctttgcttattggctcgagtggaatacgcttcccaggattacacagcgtcttatgattcagatattattttcgtccctgaccggagttacaggaaatcagatgctttattttgtggggctgaaatattcatccgctacaattgcatgtgcactgacaaatttgctcccagctttcactttcatccttgcagttctcttcagacaagagaatttgggaatcaagaagagggctggtctagcaaaggtattcgggacaatattgtgtgtgagtggagccttgcttttgtcattttaccatggaaaaaccattggtttaggccaatcaagtattcactggagatatgctgagaaaatggaaggaactagctcttctggcaaaggaaacatgttcctaggccctttggtcgtaattcttagcacccttgtttgggcagcatggttcataattcaaaaagacataagcaagacatttccagctccttacacgagcactggcttaatgtgtttcatggcaagctttcaatgcgtgatcattgccgtgtgtgtcgaccacagggcctcagcttggtcactccacaatgctatgagactttcctctgccctttatgcgggaatattttgcactggattagcctattgcctcatgtcgtggaccattgagagaaaaggtcctctttatgtctctgtatttacccctttgcagcttgtcctcactgccattttgagctgggctttgcttcgggagaaattatatgttggaactgccgtagggtctctcttgatagttttgggactctattctgttctctggggaaagagtgaagaggtgaataagggagacggtattgaagaagatgcagttaaagaagcagtcaaggattcgaagaatgacatggaattgcaatcatatgtgccatccaatggtaataatggtcgggttattgcatgaagaagggacgaggcagagtgagattcctcgcaagatgctagtagctaaggattgagaaagtttcggttatttgtctttattttatttttgctctctaccagtaaatttgaattttgatatgtgtaatcttgtgtcacatttgaaaggggttcacaactctttgcagttgcattgaagacatgtattaatattattattattattatttatatattaatcaacccggaatcagttattccatt

SEQ ID NO: 9031 - DNA, 1559 bp, Glycine max
aatcgcaagcaaatggtgtacacagctctaaacatgatgatgatggtcgcttaaaacgaagaggaacatggttaactgcgacttcacacatagtgacggctgttattgggtctggggtcctatcactggcatgggccgttgctcagttgggctggattgctgggcctgccattctgacaatcttttctgtcatcactgtcttcacttcttctctgctcagcgattgttataggtaccctgactctgttcatggaaccagaaaccataactacagggagatggtaaaaaatattctaggaggacgtaaatacctgttttgtggattggcccagttcgcaaatctgattggaacaggcattggatacaccgttactgcatccattagcatggtggctgtcataagatcgaattgctttcacaagtatgggcacgaagcgaagtgtcatacatcaaattacccatatatgaccatctttgcggtcatacagattttattaagccaaatccctgatttccaggaactctcaggcctctctattattgctgccgtcatgtcttttggttattcttccataggcattggtctctccatagccaaaattgcaggaggaaacgatgccaagacaagtctaacggggctcatcgttggagaagacgtgacaagccaggagaaactatggaacactttccaagcaattggaaacattgcttttgcatacgccttcagtcaagtacttgttgagatacaggacacgttaaaatcaagcccaccagaaaatcaagccatgaaaaaggcaacccttgctggatgctcgatcacctcactgttttatatgttatgtggcctattaggctatgcagcattcgggaacaaggcacccggaaacttcttaacaggatttgggttttatgaaccatattggcttgttgacattggtaatgtcttcgtatttgttcatttagtgggcgcctaccaggtattcacacaaccagttttccagcttgtggaaacttgggttgcgaagcgttggcctgaaagcaacttcatgggaaaagaatatcgtgttggcaagttcagattcaatggattcaggatgatatggaggacagtgtacgtgattttcacagcagtggttgctatgatacttcccttcttcaacagcattgtgggtttgcttggagctatttccttctttcctttgacagtgtattttccaacagagatgtatctggtgcaggctaaagttcccaagttttctctggtctggattggggtcaaaattctaagtggcttctgcttgattgtcactcttgttgctgcagctggatcaatccaaggaatcatcgcagaccttagaatctatgagcccttcaagtaaatatcctttgtgtagtttagctctttggatgaacaatggtttgtggctaagtttgtggtcattattgatcagttgtttggataaactttctttcaagtgttttcataatatatacttttataatggatcgataagaatgcttttagatcctagaaaaattttaaattgctttttgtcctc

SEQ ID NO: 9032 - DNA, 1642 bp, Zea mays
ttccaatcctcagaaccaataaaccgtagacgagagaagttacgagcttctccttgtcccgtgtcttttcaaggatagcccgggcgcagccgcagcatttcttggcgtcggtgtccgcgggttggcgactaagcaatggcgacgaggaaccaccgcgccgctgccgctccgcagccggcgaacagaggtgccgcgagggtcgccgggaaacagaaagccgccgccgccgggacacgccgagccctcggtgacattggcaacgtcgtctccgatgccctcgacagggcgatcaagctgccggaggggatccatcgccccatcaccaggagcttcggcgcccagctcatgaaggccgctttggcgaacaagaacgccgacgccgccgtagctcctgctcagcctgtagcggcgcgcgccgttacgaaaccagctaggaaagtgactacgaagaacgtccctcgtcctggcgctgggcaggctcccaaggagaacaagaagccatcagcagagggtgccgccgccggcagcggccgctctgtgcagaagaacaggaggaagaagcccgcgtgcacgctttcgaccgtcctttctgcgcgttctaaggctgcctgtggccttaccgagaagccaaaggagcccatcgaggacattgacaagttcgacggcgacaaccagcttgctttggtggactacgttgaggacatctacacattctacaagaccgcccagcatgagagccgccccattgactacatgggcaaccagcccgagctcagccccagaatgcgctccatcctcgcggactggctcatcgagtctcaccgaagattccagctcatgccggaaacgctctacctcacaatatacatcgtggaccggtacctgtcgctgcagcccacgccgaggagggagctccagctcgtcggcgtggcagcgttgctgatcgcctgcaaatacgaggagatctgggcaccggaggtaaatgacttaatccatatagccgatggcgcgtttaaccggagccagattcttgccgccgagaaggctattctgaacagcatggagtggaaccttacggtccccaccccgtaccacttcctgctgcggttcgcgaaggctgccggtagtgctgatgaacagcttcagcatacgataaacttctttggagagctcgcgctgatggactacggtatggtgatgaccaatccttcgacggcggctgcttgcgctgtgtacgctgctcgcctcacgttggggaggagtcctctctggacagagaccttgaagcaccacactggcctcaacgagcagcagatcatggaaggcgccaagacactggtcggatctcatgctgctagtgctagccctgatgcgaggctgaaggccgtctaccagaagtacgccacggagcagtttgggcgtgtggctctgcacccaccggcaccgactgctcttcccgaccttgtctagagtttttacttgacaagctgagggatttggttgagttcgctttgattgacaagttcgagagttgttttcgtatactctattctcgcgagtgtattagacactagtagtaacaactattcataactatatgaataaccacaatgaaaatttatgattggctgaacttctttcg

SEQ ID NO: 9033 - DNA, 1649 bp, Zea mays
tggacgccggcgacgcctccaccgcgcttgccctcacggcggcggaaccatcaccgccgagccccaacaggaggggcaagaggccgaccaacccgcccaagcgcttcgtgcacaccccgatcccgccttcaatcctctcggacccgaccctggccgccgccgccacctccctcctcccggccaactacaactttgagctccacaagacggcgcaccgcatacggtccgcggccgctcgccgcgtggcgctgcagctccccgagggcctgctcctcttcgcgctcccactgtcgcacctcctcgcgccctacctcgagcccggcgccgacaacgacgtcctcgtcctcgccgacgccacctacggggcctgctgcctcgctgaccgccccgccagggcgctcgccgccgacctcctcgtccactacggccactcctgcctcgtccccgtcacggcctcactcctcccggtgctctacgtcttcgtcgagatccgcgtggacgccgcccgcctcgccgccgccgtcagagccgccttcccggacccagcggccgcgccccgcctcgccatcgccgggaccgtgcagttcatcgccgcggtccacgccgcgcgcgagatgctcacggtagagggctaccacgacatcgtcgtgccgcaggcgaagccgctgtccgccggcgagatcctgggttgcaccgccccgacgctcaagaagtcggaggaggtgggcgccgtggtgttcgtcgccgacgggaggttccacctcgaggcgtttatgatcgccaatcccggggtgaaggcctaccgtttcgacccattcctcggggttctcgtgctggaggagtatgaccatgttggcatgaagcaggcgaggaaagcggcggtgctggcggccaggaaggccaagagctggggagtcgtacttggcaccctggggaggcaggggagcaccaaggttcttgacagggtggtggagcatttggaggagaaagagttggaacacacagtggtgctcatgtcggagctttccccggcgaggatggagctatttggagattccattgatgcctgggtgcaaattgcttgtccacgcttgtcgatcgactggggggagggtttcaagaagccagtgctgacaacgttcgagtttgatgtcgcactgggctatgtccctgggtggtgggagaaggggagcaggggttgcggtagtgaatgtggtgttgggtgttgttcaggatcaggaactcgtggaaactgcaactgcagtgatggggattatggtggtgactacccgatggattattattcgcaagatggaggtgattggaatagctgctacatgaagaagaagccatctactggcgagaggaaactgcgggttcggattggcaacgaaattcaagccgaggagaagcgtgggaatcaggattctcgtgagctagtcaggtgaatagggataccgagaacagcttcatggctcaaaaaggatttttgacaccaggttttagtgtgattgtaacgatgtttagttaccagagggaaaatcttgtgactgtacctgtatcgatgtatccaccaccccatatactgtaaatttgttacgtacaatgtctcattgtaaacatcttgagaaggtatgaggtgttgtcat

SEQ ID NO: 9034 - DNA, 1048 bp, Zea mays
caccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccat

SEQ ID NO: 9035 - DNA, 1754 bp, Zea mays
gctagctagggttctgtaaccaatctcacccatcttttctttccttcgtcggagaaggggagaaaagcgtacctgaaacgattccctgcattccattccgctgcatacttgcattgcatctcatccctcctgctcctgcgtcctcctcctctatttctctcctgctgcttgctactacctcatcgatccattccatccatcgccgaggggggagggccgccgcccgcccgggtcgcatcgcatcgcccggtcggccggggactcggggcaggcgagcgacactagctataaaagacctcccgccgcctgcgactgggccgtgtgcaagcaaagcgcaaggccgatctggggttggagggccggccatggtgatgatgatgcggtcgtgcctcggcggcggcctgctaccggtggcggtcatgctctgcctcaacgtggtggcggcggtcatggtgtcgctcgtcaaggtggccatggacggcggcatgaaaccgctcgtgatcgtcaccctgcagcagctcaccgccgccgtcttcctcgcgccaatcgcattcttcaaggagaggaagtcgaggccaaagctgacgctggagatcttcgcctacatcttcgtcagtgcggcgctcggggcagctcttcgtcagtacatgatcttcgtggccctgcgctacaccacggccaccttcgtgaccgccttctccaacatcgcccccgtgctcaccttcctcctggccgtcgctacgcggtccgaagcgctggacctcaagagcaggacggggttggcgaagctgctgggcacgctggtgtcgctggccggcgccatggtgctcaccctctacaagggcgtggcgctcacccacgcggcggcagcctcgcaggaccaccagcagcactcccacggccggttgccgccgagcgccgccgacagccgcggcaagtggacgctgggcaccgtggccatcctgggcaactgcgtctgcctctcctgctggttcctgctccacggccgcctcgccaagaagtacccgcacgtctactcctgcaacgcgctcatgtccttgctcagcttcctccaggtcgccgtcgtcggcctctgcacccagcgcagcatctccccctggatcgtcaccagcaagttcaacatcctcaccgtcctatacgccggcatcgtcggctgcggcgtctcgttcgtgctggtgacatggtgcatcgagaagagaggagccgtgttcgtggccgccttcataccggtggtgcagatcatcgtctccgtcatcgacttctccatcctgcacgagcagctctacctcggaagcgtgctgggatcagtgctagtgataggtggcctttaccttctgctgtggggcaagaggcaggaggccctgcactgtcctcctcctcctccaaaggttgccgaagaagaccctgctgacaaagagcagcagcaagtgcagcacaactgaagacggacagcatcctctgactgtttggtcgtttggttgtaacagtgccagcaataagatctctctgcctccttttcttttcttttggtgtctcaggggggtgggcaatgttccttccttctcagatcgatcaccaacaaagtgtttagattctaatccaaaacagtagaatggtcttaaatacagtactcctgcttactgatgatagcaacaccactaccaactaggcctctggagaaatacagagtagagtgtgtgtgcgcgcaatactggagagcagaatattcctgc

SEQ ID NO: 9036 - DNA, 1136 bp, Zea mays
ttcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttc

SEQ ID NO: 9037 - DNA, 4563 bp, Zea mays
gcacgaggcgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggtactggtttcctgtttccctgtttcttctctagatagatctggtgaattccacgaagatctggtccgaatcgggtacactgggtcggtcggttggtaattcctgttccgtgtgtggagttaaaaaacagctcttcttttttcacgccgctgtaggctgtagcgtcggttggacgtcgtgagcgtgcagagcaattaagcaaagcaggtgcactctttgctcaacttttttattgctattttggctgcgctcaagtgtaattattagtatgattgtggctggagttgcaagcaattgatgggtttgaagccttgagggcttcagtttgagaacggctactagggcagcatctcaagtttatccgttgctggctcatttgataacagcattaattcgttattttgttgcctattgtctgcttcgattgctgtttatgtatgtatacacaacaatgtttagttgaccagaaaaaaaaacatacacggcgttcgctttagctaaagcacagctgcaaccgctgcagctatggctggaaactactcagtgaagcactgttgaatggctgcagcagtcgtctgtttaagctcagctgaacagcttatagttgtgaaattggagggtgcaaacgaacaccatgttgcaaagaaaacacttcctttatgatgcagtaccctgctgcatcttcttttagtaaaggacgcatgcatatgagtgacaggaaacatctgctttttgtttctgtttgaacatgctatcggttttgggaaagaaagctacaattcttgggtctttgggaattaccaatttgattgatgttggtggtggcataaccgcctcactgtgactgggataataaggaaaatgctttctgaagcaatagcgataaggaggctcttctaagaaaaccttggccgcactgtctaatttatttaattgtggttttcattataggaaccaggaagtcatttattactattcaagtattatcctattgtaaagatctactaacaaagagctacctgatgctttctgattattatatctacttcatctggccgtaaatatagatacatctaggtttgtcgtaagtcaaacttagtcaactttgaccatcaataaaaaatttatgtacattgacaataggagattgttgttattagattcacttttaaaaacagtttcatttaagataagacttctatgtatatggatagtcaaagtttaaaaaatagcttgagttgggacaagcatggatggacatatttatggtagggggaagtaattgtgtgtgaataataaatggctgtagccaacctgtaagtagggactttattcttgtagaccactgcatttttaagagtatttcactgacaagttttctatttaggctacattgatgaaccttgaaaagtctactttttagtgttcgtccaaggattgggtgctccaccatgcctttacataactcttttttccatttcttcgcagggcttgggtaaatcattattgaaagcatctcccttttacatgtaaccttgcatacaatatctgttaagatgagttcactaaataaagttgtttcaaatagtggagatgcatgttcagtcttagctagtaaagtcacatcattaaatcccaatgcagcggagtttgtaccgtcatttgttaaaccatcttttggaaatggtacagttctagataagtcagatttcaggggttcttctggaaaaacaattctagataggcctgagccatcaaagtctaataactcagatgatgaggcacaccagttttggcataagcagcttccggatgacattattccagacttcacttcttttgagaaagttgaacaagggcctgaactgtcccttgctggattatccttgaatgcaccccccttttatgggacaacttccagtcgcttctcaagagaatatcacgaattatcttctccagttaccaagggcctggaactggaactagaacatactaatatgctatatgaagataaaagcaactgggagcaaaattatattggtgatcttcatattgctaatggaaaccaggaccttcattatgattctgaatctggtgtaagcttttctgatagctttgctagtgagtatgttgccccatcagatggcctttttgctcccctggagtacttggcatctcagttccctggattttcagcagagagccttgcagagctttactacgcaaatgggtgtgatttcaaccatactattgaaatcctcacccagctagaggtaattccttctttactgcaacactaatttaagtcttccagatatccactcagaattagctttacccccaaaagggaagtgattaaattcatgctcttttgctcagatatcagatcagtgttctttagaattattgtcaaaagtggtttggaagttttttttgggacatctgtggttggaaatattctttttgttccaattataagatgtgctggcttctttctagatacatgtcttttgctatgcacctagatatacattatatctagatacatagtaaaagctatatctctagaaaagctagaaggtcttataatttggaaaggagtaattattagatatacattatatctagatacatagtaaaagctatatctctagaaaagctagaaggtcttataatttggaaaggagtaattattatacgcaatggaatatgtctcccaccatttcaatcaaaatgttcggttgccacctgttagacaagaaccatatactagcatgagatttttttgtggagctcatcaagcatgccatggactggttgcacagcatcgttatcatgctgtttataagagtactatttactaaagcagtaatgctacatgaaaagacaatttgaatcatcacatctttgattgcaatgctgcattgattttataatgcttggttacatccagaacattttggcactatccataattatgttttctctgatttttcagatgcaagttgatgctacacccaatcacacactgaatctgccccacagcacaccgaacttcagcactggggatttccctgcacttccaacagctgaggaccaaaatggtttcaatcagggtaatgtggatgtacttggcatgttcaatgggcgcagttcatctgcgatgcctactggagctggtgattttgtttcagccgttcgcaaacttgcatcgcagaactctggccagtggaagtttaaaaaaggtcctgagtatggtaatggcatttcagctctttctgtacccaagcagtacagttctagcactaaacaatcgtctgggaacaagtttcaaagcatcagcagtggaagagttgccccatggcttgagactggtgatgcagtgggtaatactcatctgatactctgaagtctttctggtccatattgcacagttccctctacgtttcatgtttggatgagtattgctcttgcccgttttcttcatttagtgaaaaatcgggaatggatagatagaaatcagggagaattatgctaacttttgagttcctttactgtgatccaattatcgctgattaatttgtctctgtatatgcaatccaccagcaagtatgtactcagaatcaaggggagaggctcgtgattttgctagggtccggaatacctgctttgagcaggctagacaggcttacttggttggcaacaaggctcttgcgaaggagctcagcatgaaggggcaggcctacaatgtgcaaatgaaagcggctcatgagaaagctagagaagctatttaccgacaaaggaatcctgtttcttcccaacgtgggggtggtgaccacctgattgatttacatggcctgcatgtgaacgaagcaatccacatcctgaagggtgagctcaccgccttgaagagcgcggcgagggcagcaggggagaggatgcaagtcatggtttgcgttggaacaggccaccacaccaagggctctcgcactgcgaggttgcccatcgctgtggagcagttcctgctggatgaaggcctccagtacacgcagcctcaggcgggtctgctccgagtgatggtgtactaacatctcttaggtgagacatcacggtgaggaaaaaaactccaaaaaaagagaaaagagatgtacgaaaacgcaggaaaaaaaagcgtcgttggagcacgcactgttattccgtgtagctgtatattaaaagaggcagcaggagaatagcctgacaacaggatacagtgtaaaattatacgtagcttccttcattcaattc

SEQ ID NO: 9038 - DNA, 2334 bp, Zea mays
tggaaggtcgtctcgacatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcagaccttgtgaacaaccttggtaccattgcacgatctggcacaaaagagttcatggaggcactggctgctggtgccgacgtgtccatgattggtcagtttggtgtcggtttctactcggcataccttgttgctgagagggttgtcgtgaccaccaagcacaacgatgatgagcagtatgtatgggagtctcaggccggtggctccttcactgtcacacgtgatacctctggggagcaacttggcaggggtacaaagatgaccctttacctcaaggatgatcagttagagtatcttgaggagcgccggctgaaggatctgatcaagaagcactcagagttcatcagctacccaatctctctctggatcgagaagaccactgagaaggaaatatctgatgatgaggacgaggaagataagaaggacgaggagggcaaggttgaggatgttgatgagaaggaagaaaaggaaaagaagaagaagaagatcaaggaggtttctcatgagtggcaattggttaacaagcagaagcctatctggatgagaaagcctgaggagattaccaaagaagagtatgctgctttctacaagagcttgaccaacgactgggaggagcatctcgccgttaagcacttctctgttgagggtcagcttgagttcaaggctgtcctgtttgtgccgaagagggccccctttgacctcttcgacaccaggaagaaactgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctatgaggccttctcgaagaacctgaagcttggcatccacgaggactccacgaacaggaacaagattgcggagctgctgaggtatcactccaccaagagcggagatgagctgacaagcctcaaggactatgtgactaggatgaaggagggccagaatgacatctactacatcactggcgagagcaagaaggccgtggagaactcccccttccttgagaagctgaagaagaagggctatgaagtcctgtacatggtggacgccatcgacgagtatgctattggccagctcaaggagttcgagggcaagaagctcgtctcggccaccaaggagggcctgaagctcgatgagagtgaggatgagaagaagcggaaggaggagcttaaggagaagttcgagggcctgtgcaaggtgatcaaggaggtgctgggcgacaaggtggagaaggttgtggtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggacaacgccatcatggaggagctgcgcaagcgcgcggaggccgacaagaacgacaagtctgtcaaggaccttgtcatgcttctgttcgagacggcgctgctcacctcgggcttcagccttgacgaccccaacaccttcggcggccgcatccaccgcatgctcaagctgggcctcagcatcgacgaggacgaggctccggaggccgacaccgacatgcctcctctggaggatgacgctggcgagagcaagatggaggaggtcgactagtctggctatcgtgtcttaattggtgtgtgcgttttttttttacttttgctagcctgcaaacttcgtacgtttattattgtcggtataatagtgctccggctgcccatctctgcttgctcggtcagttttatatatgccagctgctcatcgcagcattctccctgtgcacaactccaaaatgcgggaagagatcaattattaaccgagtgaaaagtgtttatag

SEQ ID NO: 9039 - DNA, 1077 bp, Zea mays
cgcgtgtataaaagctgactggactcccagcgtctgtcagcgaagccgaagcagcagccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctcctcttcgtcttcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcacccacggcaaggccatcccgacgcacgccgtcgcgggcatcagcgagctggaaggcgtcgtgttcgaggtcgtcatcaccttcgcgctcgtctacaccgtgtacgccaccgccgccgaccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccagcaggtcgcggaccaggactacgcctaatttattcaccactccatctccgctctggatgaatggattcaaaaccgtcgtcgtttgcttttgctcctcgccacgttcaattaatggttgtgtatgcatgtatgtgccaatatgatgtgcctttgccctggtccattcatttccctttcttttttcggggtgaaatagatgtaaagatctcgtcttgcc

SEQ ID NO: 9040 - DNA, 1060 bp, Zea mays
agggaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagcttttaaagtcatcgcattcttttttgattgcaatcagttattggctggatatgcggtggctgtttggatcagaagtacagccggagtttcctcaccggagcgtgtaacatgtggaaattggaaacc

SEQ ID NO: 9041 - DNA, 1168 bp, Zea mays
cacacacacttcacccagcgcggcggccgccggccgccggcaatggaggccgtggcgcgcagcggcgactacctttggcggttcgtggcggagacagagtggtacaacgaggttgtcctcagcgccgtggcgccaggcgactggtggcgcggcctgccgcacccggtgcagtcatggatgcgcaactgcgtcggcggttacctcctctacttcatctctggtttcctctggtgcttcgtcatctactactggaagcgccacgcctacatccccaaagatgccatccccacaaatgaagctatgaagaagcaaatagttgtagcatcgaaggctatgcctttttactgcgctcttccaactttatctgaatatatgattgagagcggatggactcggtgctacttcaatatcagcgaaattggtttttctatgtacctctgttatatggctatgtatctcatctttgtggagtttggaatttactggatgcacagggagttgcatgacataaaaccattatacaaatatctgcatgcaacccaccatatttacaacaaggagaataccttgtctccatttgctggacttgcatttcatccactggatggtattctgcaagcaataccgcatgtgttcgcgctcttcctctttccaacacacttcaggacacatattgcactcttgttcctagaggctgtgtggacaacaaacatccacgactgcattcatggcaagatatggccagtcatgggcgctggatatcacaccattcaccatacgacttaccgccacaactatggccactacaccatctggatggactggatgtttggtacgctcaatgagccagaagatatcctcaagaaggcttgagtttctcggagctgtggtatccctatggtgctggtgctggaactgctcgatctgttcccagtgtttctaatccgttgagcctgttcagcactgtctgtttatgtaggcatcagtgtgttaattagtttgctaggttcatatggctttgtgcttattctgtaatttagtgatgtttgtctcatgacgcaacggagttcaggacgaataaaactttgctagacacattctggattccagttgcttgtacaatgttgcaactcaactgtcaatataggatgtaaaacggattccttct

SEQ ID NO: 9042 - DNA, 1039 bp, Zea mays
cacactgcccctctaccctgcctgccgtttccatctccatccagttctccgcacccacccacccacccactccagtcctttccccaacccatggccgccgccgccgccgccgccggcacccgggaggagatggtctacatggccaagctagcggagcaggcggagcggtacgaggagatggtcgagttcatggagaaggtcgcggccgccgccgagctcaccgtcgaggagcgcaacctgctctccgtcgcctacaagaacgtcatcggcgcgcgccgcgcctcctggcgcatcgtatcctccatcgagcacaaggaggagacgcggggcgcggcggggcacgccgccgccgccagggggtaccgcgcgcgcgtggaggccgagctctccgggatctgcgcggggatcctgcgcctcctcgacgagcgcctcgtgccggcggcggcggccgtggacgccagggtcttctacctcaagatgaagggggactaccaccgctacctcgccgagttcaagaccggcgccgagcgcaaggacgccgcggactccacgctcgccgcctaccaggccgcgcaggacatcgccgtcaaggagctgccgcccacgcatcccatcaggctcggcctcgccctcaacttctccgtcttctactacgagatcctcagctcgccggaccgcgcctgctcgctggccaagcaggccttcgacgaagctatttcagagctggatagtcttggggaagagtcgtacaaggatagcaccctcatcatgcagcttcttcgtgacaacctcaccttgtggacttctgacatgcaggaggatggtggcgatgaaatgcgggatgcaaacaagcctgacgaggagcagtagtagtcgtcatgccatgccatgccatgcttgtacaaggaccattttcgtgtgtcctttccttcaatcgtcgacctttcgttttgttgttatactgctattgtggaaccctgttactgttactgttagtgtatcctattggcaataatcaaatgtggtatggttgactact

SEQ ID NO: 9043 - DNA, 1093 bp, Glycine max
atcgctgtggtttttctttttctctgttgaggttgtcattgggagcactcaacctaaactattcaagttgtgaaagcacatcacaagaaaattcgcaagcgatggatccgaagctaaaagaggtttctcagctcttcgatcgctttaaggcttcgtttatcaggaacgactttgatacctgttccaatctcctttctcagctaaaggtgttacttacaggtttcagaagccttccaccgttgtttgcagatacacctaatgcagttcatgaattaacaatagcaagggatatatacgagcatgctgttgtccttagtgtgaaaaatgaggatcaagatgcttttgaaagggatttcttccagttgaagccttattatacagatgcctgcaatcgacttccaccatctcctcaggagtacccaattctgggtctcaacctgttgagattacttgtgcagaataggattgctgaattccatactgagttggaattgctttcatctgctgctcttgagaatccttgcattaagcatgctgtggagttggaacaatcttttatggaaggggcttacaatcgtgtcttgagtgcacgacagacagtgccacatgatacatacgtttattttatggatcttttggcaaagactgtcagagatgaaatagctggttgcagtgagaaggcctatgactatctttcaattaaggatgctaagcaaatgttgctgttctcctctgaccaggaactccttgaatatattaaagaggagcatcctgagtgggagattaagaatggtagtgtctttttccaaaaggcaaaagaatctgcaccttgcaaagaaataccctctctgcagctcatcaaccagacgcttagttatgctagggagttggagaggattgtctgagaagaaatgcaatggcggcttctgttcccaaaatttctaggtgtctggataatagttgctaatactgtcttttgaaattgttcatttctgattcaatgtgaaactataaaattgttcacctctgtattttgatcatttaggtggcagtatggttactttttttttttaacttgtgctctgggttttcc

SEQ ID NO: 9044 - DNA, 1716 bp, Glycine max
cactttgtcctccaaactcaagtgtcggaaagtttgcttcttttccactctgaatcaccctatttattttgggtctctcatctttcttcttccttccaagttgtttttggtgttggtgttggtgttgaattgagttgagaagaaaagaagaggtcatagacacacacacaagacatgtctgctgttgagtcagctgaacacaacaacatcagaggagtaccaactcatggtggacgctatgttcagtacaatatctatggcaatctcttcgaagtttccagaaagtatgtccctcctattcgccctgtcggtagaggtgcttatggtattgtttgcgctgctgtaaatgcagagacaggcgaggaagttgccattaagaagattggcaatgcattcgacaacagaatagatgccaaaaggaccttacgggaaattaaacttcttcggcacatggatcatgcaaatattatgtccattaaagatattatacgtcctccacagaaggaaaacttcaatgatgtgtaccttgtttctgagttaatggacacagatctgcatcaaataattcgttccaatcagcaattgactgatgatcattgtcggtattttctgtatcaattgttacgagggctcaaatatgtacattcagcaaatgttttgcaccgagatctaaagcctagtaatttgctattgaatgccaattgtgaccttaagattgcggactttggtcttgctagaaccacatctgaaactgactttatgactgagtatgtggtcactagatggtaccgagctcccgaattgcttcttaattgttcagaatatacagcagccattgatatatggtctgttggttgcatacttggtgaaatcataacaagacaaccgctctttcctggcaaagattatgttcatcagctgagacttatcacagagctgataggttcgccggatgatgccagccttggatttctacgaagtgataatgctcgtagatacgtaaaacagcttccgcagtatccaaaacaaaacttttctgctagatttcccaccatgtctcctggtgcggttgacttgctagagaagatgctcatctttgatccaaacaggcgtattacagttgacgaggcgttgagccacccatacatgtcacctctccatgacatcaatgaggaacctgtttgcaccagacctttcagttttgactttgagcaaccatcattcactgaagaagacatcaaggaactcatctggagagaatctgtgaagttcaatcctgcaaccatatatgtttagtgaaatatctgatgactaatatatacattttatgaccactacttggcaagttgcagcgcacagaagatatgaaaacgtattggagatactgagattcactgagtttgttgaaggtttctttcgttttagtctcatctcagatacttggataatcatattgttgagatgtactgaggaaagaaaggatcaaaatatgtttcagcagaatatcctaaagctccaactccttgttgtacttctatccttctttttagattcaaggtccatagtttagtgcattgaactgttcttgccagtttttcctatcctttacatcaagaaaaattcacaagaaaacttttaatttgtggggacagacagtatctcatattcccattgtatgacatttaaattaaattaaatgtaatggtttgttagagt

SEQ ID NO: 9045 - DNA, 1542 bp, Glycine max
acgacagaagggggattcaattgaaattcgagtttcctttttaatcacctggtttttttttttaaatttgaaggagatccaatccaaatgcatcgaatgccaatcacctgaaattccgccagatctctccctcttacacgctcttgataaaccgaaacgaagcaatagctatagcatcacacacacacaccaccgctagggttagggttagggttgggggtgttccgaagtaacaacaatggcggtctccgacggcgtcgtgaagaaaatcgtcctctcctacacctacgtcgcgatatggatcttcctcagcttcacggtcatcgtgtacaacaagtacattctggatcgcaagatgtacaactggccctacccgatctcgctcaccatgatccacatggcgttctgctcctccctcgcgtacattctcgttcgcgtcttgaagctcgttgaaccggtttcgatgtcgcgtgatctctacctcaaatccgttgttccaatcggtgcactctatccactttccctctggttttccaattccgcgtatatatacctctctgtttcgttcattcagatgctcaaggcgcttatgcctgtcgcggtttattcaattggtgttattttcaaaaaagaggcctttaagaacgagaccatggcgaacatggtttccatctcgctcggtgtagcggttgcggcttacggcgaagccaaattcgatgcatggggtgttaccctgcagcttatggcggttgcgtttgaggcaacacggttggttctgattcaaattttgctcaattcgaaggggatttcgctgaaccctatcacctcgctttactacattgctccctgttgcttggtgttcttgtccgtgccttggattatcatggagtacccttcgttgagggacaactctagcttccatttggatttcgcgattttcggcacgaattcggcttgtgctttcgcgttgaacctcgcagttttcttgctggtgggaaagacttcggctttgacaatgaatgttgctggggtggtcaaggattggcttttgattgcgttctcttggtctgtgataaaggacactgtgaccccgattaacttgattggttacgggttggcgtttttgggggttgcgtattataatcattgcaagttgcaggctttgaaggcttcggaggcgcagaagaaggctctgcaggctgatgaagaggctgggaggttgttggagcagaaggatggagaagggactggaaggaagaacgacaaccagaactgattcaagtgctgatctcattatttggtcactctcttcgattaatgttggatgacgcaggttttgtttttggttttgttctgtaatgtactctgctattaggtaattattattatcgtcgtcgttattgttattatcgttataattatattattattatgatgttacatgttacttctcacagtttaattttcatacccatatttagttatgtattggaggctgagattgacttttgttccttatattactgattcgtgtttatgggt

SEQ ID NO: 9046 - DNA, 1648 bp, Glycine max
aaacatttgaagggtagcaacagttgacatagcgcctttttagggtgagagtgggtcacagcctacttgttttctccactctcccttcactatatttatatcctaactcttgcatctcctcctcaccactttcctccctagctcccttcttttactatcttcaatggctgattcaggctcagcctcttcttccagaatgtggtgctccatccccgaacgggttcagctgcatgcggccatgttggccctgcagtttggctatgctggctttcatgtggtctcaagagctgcccttaacatgggcattagcaaacttgttttcccagtctaccgcaacattattgcttttctcctcctccttccttttgcctacttcttggaaaagaaggagagacctgccattactttaaacttcctcttacagttctttcttctggcacttgtcgggattacagcgaaccaaggtttttacttgcttggcttggacaacacatccccaacctttgcatcagcgattcagaactctgtcccagccattacatttctcatggcagtcatactcaggatagagcaagtgaggctgaacagaaaggatgggatagcgaaggtggcgggaacgatattctgtgtggctggggcgacggtgattacactatacaagggtccaacaatatatagcccaagtccacctctacagagtgagagctcagtagtagttgagtttgggacactctcatcactgggagatgcaaaggggaagaactggacccttgggtgcctctacctcatagggcattgcttgtcctggtctgcttggcttgtgctccaagcacctgtactcaagaagtacccagctcgcctctctgtcacttcctatacatgtttctttggactcatccaattccttgtcattgctctcatcgttgaaagagatgctcaggcttggattttccaatctggtggagaagttttcactattttatatgcgggagtggtggcatctggaattgccttcgctgtacagatatggtgcattgacagaggtggccctgtgttcgttgcggtgtatcagcctgttcaaactcttgttgtcgctattatggcttcccttgctttaggcgaagagttctacttgggcgggatcataggagcagtgttgatcgttgtgggactgtactttgtcttgtggggtaaaagcgaagagagaaagtttgcaaaggaacatgctgcaattacgtctactccagagcacagtggtatcaggtcctcaagccatgccaaaacattactcactcagccacttctcccttcatctacggagaatgtctgatcaacaaaaccatatatgacttcaagctggggcaccattttctctgagagaaaaagggaaaaagaagatattaaaagaagaaaatgatacccagttatatacattattaccactttatgtcaggaagcttgtgtgtgtacgaaggggttttcatcttttttattttactttattttggttaattcacatgctttctttctaggacttttagaatgagggttttctatgggaatcattacaatgatggatgccacgtaaaagcgggctttaaagactgaaatcccatatgcttttatatgttgattaatggtttgattt

SEQ ID NO: 9047 - DNA, 1821 bp, Glycine max
tatcgagctacatatttcacagccatgttgccaagaagtagaacccttcctagcagaatccaccaaggaattatagaagagaggcacgatgtcaggccctacgtacaagtagaagtgcgacccaataatatccaaacggagacccaagcgatgaatatccagtctaactattccaagtgcttcgatgatgatggtcgcttgaagagaacaggaacattttggacggcaactgctcatatcatcactgctgtgatagggtcgggagtcctttcactagcatgggcggttgctcagcttggttgggttgctggacctgttgtcatgtttctctttgccgtcgtcaatctctacacttccaacctattaacacagtgttacaggaccggtgactccgttaatggacacagaaattacacctacatggaggctgtcaagtccatcttgggaggaaaaaaggtcaagttatgtggcctcatccaatatatcaatctgtttggagttgcaatcgggtacaccattgctgcctctgtcagtatgatggccataaaaaggtcgaattgctatcacagcagtcatggaaaagatccctgccacatgtcaagcaatgggtatatgataacatttggaatagcagaagtgatattttcccaaatcccagactttgatcaggtgtggtggctatccatagttgcagctatcatgtccttcacttattcttcagttggattgagtcttggagtggccaaagtagcagaaaataaaactttcaaaggaagcctgatgggaattagcattggcacagtaacacaagccggaacagtcaccagcacacagaaaatatggaggagtttacaagctcttggggcaatggcctttgcatactccttttccattatcctcatcgaaattcaggacaccataaaatctcctcctgcagagcacaagaccatgagaaaggccacaacattgagcatcgcggttaccacagtgttctatttactctgtggatgcatgggttatgcagccttcggagataatgcacctggaaatctcttgactggttttgggttctataacccttattggcttctggacattgccaaccttgcaattgttatccacctagttggggcatatcaggttttttcccagcccttatttgcatttgtggaaaaatggagtgtacgcaaatggccaaagagcaattttgtcacggcagaatatgatataccgattccctgctttggtgtgtaccaactcaacttcttccgcttagtatggagaaccatttttgtgctgttgacgaccctcatagccatgctcatgccttttttcaacgatgtggttggaatacttggcgcttttgggttctggcccttaacagtttatttccctatcgacatgtatatttcgcaaaagaagattggacgatggactagtcggtggattggacttcaattacttagtgtcagttgcctcatcatttcattgttagctgcagttggttccatggcaggggttgttttggacctcaagacttataagccatttaaaactagttattaagtgagatttaaagaaggtcgtagaaatagaagtgtttaagcttgatgatattatagaaaactaatgataagttggtttgtgaaatttaagtatatacgctccatgccgctgctgttagagcaattgatttgagaagaagaaaaaaatgataattggacataacatacctcagaatttggacgtatacgtgtctgtgtaactgctatattgaagtcaattgtaaggaataaaagtctttgaacgtgttatttcttt

SEQ ID NO: 9048 - DNA, 1266 bp, Glycine max
atttggaccccaaacacgttgataggtcttggcttgggacagtttctttctcttctcatcacttccaccggcttcacttcttctcaattggctaaaaaaggaattaatgctcctacttcacagtcgtttctgaactatgtgttcttgtctcttgtctatggaactattctcctctatcgaaggaaagcactcaaggcaaaatggtactattatataattctcggattggttgatgtagaagcaaattttcttgttgtgaaggcataccaatacacctcacttacaagtgtgatgctgcttgactgctggtcaattccgtccgtcatgcttcttacatggcttttcttgaaaacaaaatatagattcaaaaagattaccggtgtagttgtttgcgttgctggccttgtcttggttgtgttttctgacgttcattcaggtgaccgtgcaggtggaagcaatcctcgtaaaggggaccttcttgttattgctggtgctaccttgtatgcaatcagtaatgtcagtgaggaatttcttgtgaaaaatgctgatagagttgagcttatggcaatgttaggtctctctggtggcattatcagtgccattcaaataagcatacttgagcgcaatgaacttaaatctattcattggtcggcagaggcggcgcttccttttgttggatttgcagtggccatgtttatgttttactctttagtccctgttctacttaagatcaatggttctaccatgctaaatttgtctctgttgacctcagacatgtgggctgtcttaattcgcatttttgcttaccatgagaaggttgattggatgtactttgtgtcatttggtgccgttaccattgggctcataatctattcaggaggggacatagatgaggatcagcaccctccaaatgctgccatcgttgatcttggccctgcagtcaaacaagatgaggaagccaattcaggaaatcatagcaaaggaactgcggctggaagctcaaaaacatgggtagcttagtatagacctacagattcatacacagaaaatcaatgaggaaaagtatcctcaagagaatggagattagtctaaatctattatgtattggcagctcctgcaagattgcaatccaagaagcaaatgatccttcaaatgctgctcttgttcacatgtcttgtaatttaaaggattctctaagtttcgttagatgtaattttgagaaatcatctggagatcaatagccaatttttcagtcagtatgttgtt

SEQ ID NO: 9049 - DNA, 1625 bp, Glycine max
caactacacttcagatctggcaccatcaccccaaacctaaaaaacaaaacatcatcgtactatttcccatttggcggcgcggcgatggtggaggcgcagacatggacgacgcggcgaatgagcaaccctcggctggacaccagcacgacggaccaagtactggacattccccccacacccccgggggagctccgcaacagcttcggatcgaaccctaacaacctctccccgaccctgttaactgctctcatcatttcatcttggtacctctcgaacatcggagttcttctcttaaacaagtacctcctcagcttctacggctaccgcttccctatcttcctcacaatgctccacatgctatcatgcgccgcttattcctacgcctccatcaacttccttgaactcgttcctctccagcacatccactccaagaagcagttcctcaagatcttcgctctcagcgccatcttctgcttctccgtcgtctgcggcaacacctccctccgctacctccccgtctccttcaaccaggccatcggcgcaacgaccccgttcttcaccgcgatttttgcgtttttgatcacatgcaagaaggagactggggaggtttacctcgccctgttgccggtggtgttcggtatcgtcgtggcgagcaacagtgaacccctttttcatttgtttgggtttctggtctgtgtcggttccaccgctggtcgcgctttgaagtctgtggttcaggggattttgttgacttctgaagcggagaagcttcactccatgaacttgcttctctacatggcacccttggcggcgatgattttgttgccgttcacgctctacattgaaggaaatgtgctggctttgactattgagaaggcgaaaggtgacccctttattgtgttcttgctgcttgggaatgccaccgtggcttatttggtgaacttgacgaatttcttggtgacgaagcacacgagtgctttgacgctgcaggtgttggggaatgccaaggcggcggtggcggcggtggtttcggttttgatcttcaggaatccggtgacggttatgggaatggccgggttcggaatcaccataatgggggtggtgctttacagtgaggccaagaagaggtccaaagttacgactcattgattcattcgcacgcacgccgttttggtttcttttttggcttttatcataacaccttattcttcgggtatttttctttctttctttgtttttattgatattgcacaatttagtttgatttaattttatcattatatttccgtggaattgggtcgaattaattacagcaattggactgtataggaaggaaggaaggagaagcagaaaatggggtgggagtgggagggattattattacttggtgttgttgttgggtttctgttggccgttgtgtaagcttatatatgaaacgctctatgccctttggcaacatacataaaaacgttcaaagaacgaaaaaccttatgtgtatttggctagggaggaaaattctccctccctgcattttgttgatcacatcatcatccatttttttttggcttttttgtcatttggtgttttgttagctttaattttgattcgtttgtgaggttcgagct

SEQ ID NO: 9050 - DNA, 902 bp, Oryza sativa
gtttgggatgcgcgttgctgcgacgacgcggcccgcctcctcctccgccgccgctccgctccccctcttcctcctcctcgccgtcgccgccgccgccgccgccctgttcctcgtcggctccgcgtccctcgccatggccggccacgtcctcggcggcgcgcacgacgccccctccgccgccaacagcgtcgagaccgacgcgctcgcccgcttcgccgtcgacgagcacaacaagcgcgagaacgcgctgctggagttcgtgcgggtggtggaggcgaaggagcaggtggtggccggcacgctgcaccacctcacgctcgaggccctcgaggcggggaggaagaaggtgtacgaggccaaggtctgggtcaagccgtggctcgatttcaaggagctccaggagttccgcaacactggggatgcaaccaccttcaccaacgccgacctcggcgccaagaaaggtggacatgagcctgggtggcgtgatgttccagtacatgatcctgtagtcaaagatgctgcagaccatgctgtgaaatcaatccagcagaggtcaaactccctgtttccatatgaacttctcgagatcgttcgtgcaaaggcagaggttgttgaagacttcgcaaagtttgacattctgatgaaacttaagaggggaaacaaggaggagaagttcaaagccgaggtccacaagaaccttgaaggggcatttgtactgaaccagatgcaacaagagcatgatgaatcgagcagccagtgaaccttgccacattaagctgtagttatgtagtttgtgttcaataagaaaacagtgaacatgcacccttccgtttctatcgggacataggctggaacttgttcctaacatcgatgaaaagaagacactacactatccttttgtt

SEQ ID NO: 9051 - DNA, 1246 bp, Oryza sativa
caccctcccggcggccggagcggcgcgacttcccatctaacatattgcttccggcagccgccgccggacaccatggctgactctccgagcccacgcctggacgaggaggacgccttcggccgcgacttcaactcgtccccttcgcccacagccccacccgcccgctccggcgagaagaggccgttcggcgatctggacgacgatgacgaggacgttttcgcttccaagaagggaaagacaaaggtggaagaaagtgcgccaggtgctgccacgggaatgattctgtctcttcgcgagagtttgcagaactgtaaagataatcttgcgtcatgtcaggtggaacgggaggctgccaaatcagaagttcaaaagtggcattcagcatttcagaacattccagctgtacctgctggaaccaatccagatcctgtttcggttgtttcttatctcaataacctgaagtcgtcggaagaatcattgaaggagcagctggagaaagctaagaaaagagaggcggctttcattgtaacatttgcgaaacgtgaacaagaaattgcagaactgaagtctgcagttagggatttgaaaactcaattaaggccaccatcgatgcagacaaggagattattgcttgatccagcaatccacgaggaatttacacgattaaagaatcttgtggaggagaaggagaaaaagatcaaggaactacaggacaatgttgctgctgtcaattttactccatccagtaaacatgggaaaatgctaatggccaagtgtagaacattgcaagaggaaaatgaagagattggggcgatggcttctgaaggaaaaatccatgaacttggaatgaaaattgcagttttgaagactcggaacaatgaactcaggaatcagttcaatgagctgtataaacacatggatggtctaacaaatgacgttgaaagatcaaatgaaatggtggccattcttcaagatgagttagaaacaaaagatgtagagctgagaagattgaaggagatgcttgcccagaaagaagcaactgatgagaacaaaatacctcaagaaaatgacgtcgctggagatgatatagttgctgccgccgagagtcagccaataaaagtagaaacataagctacgccttcagcagtcatttctagagtagcttgcgttctcaacattcttattattttttgtatcatgtatcagaagtgtttacttgtgtaatttatctaatgtcgtttattct

SEQ ID NO: 9052 - DNA, 1350 bp, Oryza sativa
cgtcggtgtgccagcaccctcccggcggccggagcggcgcgacttcccatctaacatattgcttccggcagccgccgccggacaccatggctgactctccgagcccacgcctggacgaggaggacgccttcggccgcgacttcaactcgtccccttcgcccacagccccacccgcccgctccggcgagaagaggccgttcggcgatctggacgacgatgacgaggacgttttcgcttccaagaagggaaagacaaaggtggaagaaagtgcgccaggtgctgccacgggaatgattctgtctcttcgcgagagtttgcagaactgtaaagataatcttgcgtcatgtcaggtggaacgggaggctgccaaatcagaagttcaaaagtggcattcagcatttcagaacattccagctgtacctgctggaaccaatccagatcctgtttcggttgtttcttatctcaataacctgaagtcgtcggaagaatcattgaaggagcagctggagaaagctaagaaaagagaggcggctttcattgtaacatttgcgaaacgtgaacaagaaattgcagaactgaagtctgcagttagggatttgaaaactcaattaaggccaccatcgatgcagacaaggagattattgcttgatccagcaatccacgaggaatttacacgattaaagaatcttgtggaggagaaggagaaaaagatcaaggaactacaggacaatgttgctgctgtcaattttactccatccagtaaacatgggaaaatgctaatggccaagtgtagaacattgcaagaggaaaatgaagagattggggcgatggcttctgaaggaaaaatccatgaacttggaatgaaaattgcagttttgaagactcggaacaatgaactcaggaatcagttcaatgagctgtataaacacatggatggtctaacaaatgacgttgaaagatcaaatgaaatggtggccattcttcaagatgagttagaaacaaaagatgtagagctgagaagattgaaggagatgcttgcccagaaagaagcaactgatgagaacaaaatacctcaagaaaatgacgtcgctggagatgatatagttgctgccgccgagagtcagccaataaaagtagaaacataagctacgccttcagcagtcatttctagagtagcttgcgttctcaacattcttattattttttgtatcatgtatcagaagtgtttacttgtgtaatttatctaatgtcgtttattcttgccgatttgcattgcgctttgtctgagcactgcagcatgagacgtgttacctacttaccttgaatctaaactctcttagttcgtgcgtc

SEQ ID NO: 9053 - DNA, 954 bp, Oryza sativa
gcggcttctcccttctcttctctctctcgcatcgcctactcgttcgttttccctcgaggaggagcagaggcggcggcggcggcggcggagcggacatggctgaggtggaggcagcgccgattgcggcggcggagaccccggaggtggcggcggcggagggagcggcggcggcgaaggcgccgcacaagctgcataggcagtgggcgttctggtacgacatccagtccaagcccaagcccggcgccgcgtgggggacctcgctccgcaaggcctacaccttcgacaccgtcgaggagttctggggcttgtatgatcagattttccgtccaagcaaggtgacagtaaatgctgattttcatttattcaaggctggtgtagaaccaaagtgggaagacccagagtgtgcaaatgggggcaaatggactgtgccatgtagcaggaagaccacccttgagaacatgtggcttgaaacgctgatggctctgattggagagcagtttgatgaaagtgaggaaatttgtggagttgttgctagtgtccgccagagaggagacaagcttgcattgtggactaggactgccagcaatgaagccgttcaggtaaacattggcaagaaatggaaggagattgttgactacaatgataagatggtctacagcttccatgatgacgccaagagggagaaaccaagcagaggtggacggtacaacgtgtaagtcaccgcaaaacgttgcagcttggatagtggccatcgagtggtgtgccgataccggcgcctgttctttacagcctcagctagtgttgttgtccgaggcaatttttccgacctattgtgttgctttcctctctgatagcttatggtaaaagatacaaagatgttgaggagtttgtacgccacttaattttgctcgtaacatacattgacaatcaagaggagccatggcattgcgatct

SEQ ID NO: 9054 - DNA, 3341 bp, Oryza sativa
cactactaataccaccaccgccgcgccggaggtggaagacggacggggtagagttggggtctcgcggtgagccgattcctctctagtggtcgcgcctggtgtgttcgccgacgacgccggcgtcgcgtcagccatgggtgggctcgaggagatcaagaatgaggccgttgatctggagaacataccgatcgaggaggtgttcgagcagctgaaatgtacgcgcgaggggctctcctccgaggaggggaaccggcgtatcgagatgttcggccccaacaagctcgaggagaagaaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttgcccttcaacccagttgacaagaggactgctctaacatacatcgatgccgatggtaactggcaccgtgccagcaagggtgctcctgagcagatcctgaccctgtgcaactgcaaggaggatgtaaagaggaaggtgcatgctgtgattgacaagtatgctgagcgtgggcttcgttctcttgctgttgcaagacaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctgagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccatttatgcagtttccatcaccatccgtatagtgcttggatttttgcttattgctctgatctggaaatacgacttctcacccttcatggtccttatcattgccatcctgaatgacggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggctgagagagctgaacactctcaagggccacgtcgaatcggtggtgaagctgaaggggctggacatcgacacgatccagcagaactacacagtgtgaggaaccccctcggcattcaacgagagatcgtcatcagcgctggagcgggaattgcaaacggcgctctggttaaaggaaattttcgatgaatgattggaagaacaaaaaacaaaaaaacatggctgatctgaacagccctagttgtaaagtgctaccaaatatatggtccggtttccctcttctagagaggttttacgttctagtggagtaccgtacgtacgtgttggagtacgacgacgtgttgtgatcgtttttggtctttttttactcttttccccctaactagcggtcttcttgcggaatgcaagatggagaaataatggatgaaaaattttctgccacgttaattctc

SEQ ID NO: 9055 - DNA, 1021 bp, Oryza sativa
cgaagggaaagtttgggatgcgcgttgctgcgacgacgcggcccgcctcctcctccgccgccgctccgctccccctcttcctcctcctcgccgtcgccgccgccgccgccgccctgttcctcgtcggctccgcgtccctcgccatggccggccacgtcctcggcggcgcgcacgacgccccctccgccgccaacagcgtcgagaccgacgcgctcgcccgcttcgccgtcgacgagcacaacaagcgcgagaacgcgctgctggagttcgtgcgggtggtggaggcgaaggagcaggtggtggccggcacgctgcaccacctcacgctcgaggccctcgaggcggggaggaagaaggtgtacgaggccaaggtctgggtcaagccgtggctcgatttcaaggagctccaggagttccgcaacactggggatgcaaccaccttcaccaacgccgacctcggcgccaagaaaggtggacatgagcctgggtggcgtgatgttccagtacatgatcctgtagtcaaagatgctgcagaccatgctgtgaaatcaatccagcagaggtcaaactccctgtttccatatgaacttctcgagatcgttcgtgcaaaggcagaggttgttgaagacttcgtaaagtttgacattctgatgaaacttaagaggggaaacaaggaggagaagttcaaagccgaggtccacaagaaccttgaaggggcatttgtactgaaccagatgcaacaagagcatgatgaatcgagcagccagtgaaccttgccacattaagctgtagttatgtagtttgtgttcaataagaaaacagtgaacatgcacccttccgtttctatcgggacataggctggaacttgttcctaacatcgatgaaaagaagacactacactatccttttgttcctgttgctcttagtgtgataatacgatactggtcgtgtaacttctcaagggaaccgtgggtctatgccatacagcttgtgaatgtgaaatcctatgttgatacttctc

SEQ ID NO: 9056 - DNA, 951 bp, Oryza sativa
gacggagaagcgagaggggaagagcaccgacctcgacctagctaattaaggcgcaacacagaaaccctcaccgccgcccgcatccatggcggaggagcacgagacgaggccgccgtccgccggaaggccgccgtcgtccggccgcggcagggccgacgacgctgacgagagggaggagggggagatcgccgacgacgactccggccacgcgccgccgcaggccaaccccgccgcgccgcacccgctcgagcacgcctggaccttctggttcgacaacccgcagggaaagtccaagcaggcaacctggggaagctccatccgccccatccacaccttctccaccgtcgaggacttctggagcctttataacaatatccatcacccaagcaagttggttgtgggagctgacttccattgctttaagaataaaatcgagccaaaatgggaagatcctatctgtgctaatggaggtaaatggaccttcagctgtggcagaggaaagtccgacacaatgtggttgcatactttattggcaatgattggcgaacaattcgattatggggatgaaatttgtggagcagttgttagtgtgcgtggcaagcaggaaagaatagctatctggactaaaaatgctgccaatgaagctgctcagataagcattgggaagcagtggaaagaatttctggattacaaggactcgattgggttcattgttcatgacgatgcaaaaaagatggacaaaggtctcaagaaccgctacacagtttgatctgagcactcctgtccagatatccaagagagtagtatatccacatgtaggatgggttttcttcgatgctttagtgtttgtcattcgcttgtagcgagcgcttgaaggctataatattgccgtgaactgtttaaacttgaaacgtaatataatgacgtatcagaggtgtctctgtactctat

SEQ ID NO: 9057 - DNA, 1200 bp, Zea mays
acaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaagaatttcctgtatcagttatgcaaaggagttgcacactgccatagccatggtgtccttcaccgggatttaaagccacaaaacctgctggtggacaaggagaagggtatactgaagattgctgatctgggactcggtagggctttcactgtgcccatgaaaagctacacccatgagattgtgaccctttggtacagagctcctgaagttttgcttggagcaacacattactcaactggcgttgatatgtggtctgttggatgcatctttgctgaaatggcccgacggcaggctctctttcctggtgactcggagttgcaacagttgcttcacatcttcaggttgctgggaacacctactgaggaacagtggcctggagtgagtgatttaagggactggcatgagtttccacagtggaagccccagggtttggcacgtgtcgtcccaacactggaacctgaaggagttgaccttctatcgaaaatgcttcagcttgatccttcaaacaggatatcagctttagctgcgatggagcatccctactttaacagccttgacaagtcccagttctagccgttgtactatgtggttcagaaggcgctaccctcgtacagagagatttccaatggtgttatgaatctcaattgccatctaggcaactggttcatgattttaccaatctgttagtgagtgaaaatcgtgcgagggtcatatgtgttccccttgtcttaaaaatctggtgtggtgtagaacaagagttacctgtgggaggcctgtgataatgccctttatgtctcaacatccattttcgtgcattccatgttcttcaatacggacttgaaacaggaattctgattttcttatt

SEQ ID NO: 9058 - DNA, 1682 bp, Oryza sativa
cccattaccacctccacctcgcgcactcagtctgtactacctgtacgtacgtggccgccgctagctaagctaggaattgaaatggggatggagaggccgcaagagaaggtggccaccaccaccaccgccgccttcaacctcgccgagtccggctacgccgaccgccccgacctcgacgacgacggccgcgagaagcgcacagggacgctggtgacggcgagcgcgcacataataacggcggtgatcggctccggcgtgctgtcgctggcgtgggcgatagcgcagctggggtgggtgatcgggccggccgtgctggtggcgttctcggtcataacctggttctgctccagcctcctcgccgactgctaccgatctcccgaccccgtccatggcaagcgcaactacacctacggccaagccgtcagggccaacctaggtgtggccaagtacaggctctgctcggtggcacagtacgtcaatctcgtcggcgtcaccattggctacaccatcactacggccatcagcatgggtgcgatcaaacggtccaactggttccatcgcaacggccacgacgcagcctgcttggcatctgacacgaccaacatgatcatatttgctggcatccaaatcctcctctcgcagctgccgaattttcacaaaatttggtggctctccattgtcgctgctgtcatgtcactggcctactcaaccattggccttggcctctccattgcaaaaattgcaggtggggcccaccccgaggcaaccctcacaggggtgactgttggagtggatgtgtctgcaagtgagaaaatctggagaacttttcagtcacttggtgacattgcctttgcatactcctactccaatgtcctcatagaaattcaggacacgctgcggtcgagcccggcggagaacgaggtgatgaagaaggcgtcgttcatcggagtctcgacgacgacgacgttctacatgctgtgcggcgtgctcggctacgcggcgttcggcaaccgcgcgccggggaacttcctcaccggcttcggcttctacgagcccttctggctcgtcgacgtcggcaacgtctgcatcgtcgtccacctcgtcggcgcctaccaggtcttctgccagcccatctaccagttcgccgaggcctgggcgcgctcgcggtggccggacagcgccttcgtcaacggcgagcgcgtgctccggctgccgctcggcgccggcgacttccccgtcagcgcgctccgcctcgtctggcgcacggcctacgtcgtgctcaccgccgtcgccgccatggcgttccccttcttcaacgacttcctcggcctcatcggcgccgtctccttctggccgctcaccgtctacttccccgtccagatgtacatgtctcaggccaaggtccggcgattctcgccgacgtggacgtggatgaacgtgctcagcctcgcctgcctcgtcgtctccctcctcgccgccgccggctccatccagggcctcatcaaatccgtcgcacattacaagccattcagcgtctcctcatgatcaaattaataattatttgttaatactgatgatgatgatgatatgatccatcgatcgatgaagaacaaatatatatatatagcgagatcgatcgatcgatcaagatcgtgaatgatatatataatacatagttaatc

SEQ ID NO: 9059 - DNA, 2080 bp, Oryza sativa
ctcctcctacgtctccgccgctcctcacttcctccactcgatttcctttcttggcctctcctcctctgacacaggggtgtgcaggtttgtgtttgtgcgtggcgcgtccgccatggctcgcggcagcggggccggaggaggcggcggcggtggtggcggggggctggagctgtcggtcggggtcggcggcggcggcggcgcgcgtggtgggggaggcggtgaggcgacggcggcggtggagacggcggcgccgatcagcctcgggaggctcatcctctccgggatggtcgccggcggcgtgcagtacgggtgggcgctccagctctccctcctcaccccctacgtccagacactcggactgtcgcatgctcttacttcattcatgtggctctgtggtcctattgctggcatggtggttcaaccatgcgtgggtctatacagtgataggtgcacctcaaaatggggaagacgaaggccatatattcttacaggatgtgtgttgatatgcttggctgtcgtagttattggattttcagctgacattggatacgccatgggtgatacaaaggaagactgcagtgtctaccatggatcacggtggcatgctgctattgtatatgtcctgggattctggcttcttgatttttccaacaacactgtgcagggtccagcacgtgctctaatggctgatttatcaggacgtcatggacctggcacagctaactccatcttctgttcttggatggcaatgggaaacatcctaggatactcctctggttccacaaacaattggcacaagtggtttccattccttaaaacaagagcttgctgtgaagcttgtgcaaatttgaaaggtgcatttctggtggctgtgattttcctgtccctgtgcttggttataactctgatatttgccaaggaagttccattcaaaggaaatgcagccctcccaacaaaatcaaacgagccagctgagcctgaaggcactggtccactagcagtgttgaaaggcttcaggaacttacctactgggatgccttctgtgcttattgtgactggccttacctggttgtcttggttcccattcatcctctacgacactgactggatgggccgtgagatctaccacggtgacccaaagggaactgatcctcagatcgaggctttcaaccagggtgtcagggcaggtgcatttggcctgctactgaattcgattgtgctaggattcagctcattcttgattgaaccaatgtgccggaaagtcgggccaagggtggtgtgggtgacgagcaatttcctcgtctgcatcgccatggctgcaactgcactgatcagcttctggtcactcaaggacttccatggaactgttcagaaagccatcactgcagacaagagcatcaaggctgtctgcctcgtcctctttgcgtttcttggagtccctctcgccgttctgtacagtgttcccttcgcagtgacggcgcaattagcggccactagagggggtggccaagggctctgcaccggcgtcctcaacatctccatcgtcatccctcaggtggtcatcgcgctgggagccgggccgtgggacgagctgttcgggaaggggaacatcccggcgttcggcctcgcctcgggattcgcgctcatcggcggcgtcgccggaatattcctgctgcccaagatctccaagcgccagttccggtcggtcagcatgggcggcggtcactgaccgccccgctctcgccgccggctgcggcggcggcggcggccggagcagcgccgccggaagtggtgagctttgtagttctcgtttgcaatggatcaaaggagccccctctttttttttacatagggtaattaattaattaaggctgttaattaggaaggggtgaggtggccctgcagctggggcccacgctttgttgccacctcggtagaagagaataagcagatcatgcagataatatggaactgtaaaactgttttgtgttgtgtgtgtgtgcagtgtgcttggtaattagtgtgtaatgaatggtcaggagaagtgcagtgaactaagtgaaagtgagcttccatcatc

SEQ ID NO: 9060 - DNA, 2212 bp, Oryza sativa
gcgccccgaccttatctcctttccccccaccacctccaagatatttccccacctccgccgccgccgccgccatggagtccggcctcgtcgcaagccaccgcctccgcgtccccttcgccgccgcccaccaccgccaccacccggccgcgccgccgcacctcctccgccagcggcggggcagcgtcgccgccaccccactccggctcgggctccacctccccacgccgaccccgctccgcctccccgccgcgctcccgctccgcccttccctcccgcctctccgcgccgccgccgcgtcggcggcggcaccggagccggtggggtcggcctcgcccaagttcctgggcgtggagacgaagacgctgaagaagatcgtgccgctggggctcatgttcttctgcatcctcttcaactacaccatcctgcgggacaccaaggacgtgctcgtcgtcaccgccaagggcagcagcgcggagatcatcccgttcctcaagacgtgggtcaacctccccatggccatcgggttcatgctgctctacaccaagctcgccgacgtgctctccaaggaggccctcttctacaccgtcatcttccccttcatcgccttcttcggcgccttcggctacctgctctaccccatgcgcgacgccatccaccccaccgcgctcgccgaccgcctcctcgccgcgctggggcccagcttcctgggccccgtcgccatcctccgcgtctggagcttctgcctcttctatgtcatggccgagctctggggcagcgtcgtcatctccgtgctcttctggggattcgccaatcagattactacggttgaagaggccaaagagttttacccactgttcgggcttggggccaatgtggcactcatcttctcgggtcgcacagtgaaatacttctcaaacatgaggcagaatttgggtccaggggtggacggatgggcgatttcattgaggggcatgatgagcatagtggttttgctgggccttgtgattgccggcatctactggggagtaaacaagtttgtaattgataaatcagctgcgccagtcgtcgagcggaagaagaaggataagccaaagctgagtatgggagagagtttgaaggtgcttgtgtcatctcggtatgtgagggatcttgccaccctggtcgttgcttatggtataagcattaaccttgtggaggtgacatggaagtcaaaactgaaggcacaatacccaagccctaatgaatattcttcattcatgggggatttctcgactgctactggcatagccacatttacaatgatgttgttagggagagtaattcttaggaagtttgggtggggagtcgcagctacaatcacccctgcagtgttgcttctcactggagttggattcttctcactgattttattcggtgagccattgactcctcttatggccacacttggaatgacacctttgcttgctgcggtctatgttggggcaatgcagaacattttcagtaagagtgcgaagtacagtttgtttgacccttgtaaggaaatggcatacattcctttggacgaggacatgaaggtcaaaggtaaggcagcaattgatgtggtctgcaacccattggggaagtctggaggcgccttgatccagcagttcatgatcttatcatttggatctctcgcaaattctacaccctacctgggaggaattctattggtaattgttcttgcctggttgggtgctgtaaggtcccttgactcacagttctccccactggcaaagcaagagcttgagaaggagaaaatgctgaaagcaaagacggtcgaaacaactgctcaagttgttgggtcaggaaatggttctctccaagaaactctagccagtgagaactctgcgaatggttcggccatcaaagtgtctcaggaacctgagagtacgacctcggagaagtctggtcaacaatctcaataagttctttgccttgcaaatttagttagtataagtcttccgtggaatcaaaagctgcttagtttggcctgccctgggttgttgctgaggaaagcagcagagtggtaagaaaaataagcaggccattttttttgtgttgttgtagcatgtatattttgacttcaccttgagaattgtctttagttctttgcttgagaatatctgtagctgtctgttgttccatcccatagatatgaaactgcctttttggt

SEQ ID NO: 9061 - DNA, 1265 bp, Oryza sativa
gcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctggtgctgggaaatcatgactacaggggtgatgtgctagcacagcttagcccagtcttgcgaaagatcgaccagcgattcatttgcatgaggtcgttcattgttaatgcagagattgtggatttcttctttatcgacacaactccatttcagctgaaatattggactcgccctaaagaccatcattatgactggagaggagtggcacctcgacaaaaatacataactaatctacttaaggatatggatgaggcaatgaagaaatcaacagcgaagtggaagattgctgttgggcatcataccattaggagcgtcagtgaccatggtgacaccaaggagcttctgcaacttctacttccagttctgaaggtcaatggcatcgacttctacatcaatgggcacgaccactgcctggaacacattagcagcagagacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcatgaggcagatgcaaaaccacaaaacggagaattagcttggctaagatatttgtatcaaatttgaatgcattattgtggcacgcaagggaagaggaccggaaaggaaataggaaagtatttaagcatggcatgtgattgatctactaaagaaatttgagacaaggccgagaccatcctactagactaggaaaagagatgttcagtatggtatccattagatctgattc

SEQ ID NO: 9062 - DNA, 1490 bp, Oryza sativa
ctccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgt

SEQ ID NO: 9063 - DNA, 1554 bp, Oryza sativa
ctccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgctattgtgaatgagtacattgaagccatgaagaagctcgcatgtgagatcctggacctgttaggagaggggctaggtcccaaggaccccagatacttcagcaagcttaccacaaacgctgacagtgactgcctcctgaggatcaaccactaccctccatcatgcaacattcacaaacttgaccatgatgaccaatgcattatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgtaatattgctagcattgtatataagctatggttgtatggaagtatgtaatatagccttttcagct

SEQ ID NO: 9064 - DNA, 1552 bp, Oryza sativa
ccaacatcctgagctccaatctcccactccattccggccgcgcattctcccgctctcgatcgatcgatcgatcatggtggtgccttccgcgacgacgccagcgaggcaggagacggtggtggcggcggcgccgccagctgcggcggcgtccggtgtcgtcggcggcggcggcggcgtgacgatagcgacggtggacatgtcggcggagcgcggcgcggtggcgaggcaggtggcgacggcgtgcgcggcgcacgggttcttccggtgcgtcgggcacggcgtgccggcggcggcgcccgtcgcggcgaggctggacgccgcgacggcggcgttcttcgcgatggcgccggcggagaagcagcgcgccgggccggcgagcccgctcgggtacggctgccggagcatcgggttcaacggcgacgtcggcgagctggagtacctgctcctccacgccaaccccgccgccgtcgcgcaccgggccaggaccatcgacgccatggacccctctcgcttcagtgctattgtgaatgagtacattgaagccatgaagaagctcgcatgtgagatcctggacctgttaggagaggggctaggtctcaaggaccccagatacttcagcaagcttaccacaaacgctgacagtgactgcctcctgaggatcaaccactaccctccatcatgcaacattcacaaacttgaccatgatgaccaatgcaatatcaagagccttgttagcaccaaggctagcaatggtgggaatctgatggcaggtgggcgcattgggttcggcgagcactctgacccgcagatccttagcttgctccgagcaaacgatgtggaagggctacaggtgtttgtgccggaccacgagggcaaggagatgtgggttcaggtgccatcggacccatcggccattttcgtcaatgttggtgatgtcctccaggctctgacaaatgggaggctgataagtatccggcacagggtaattgcaaccgcctgcaggccaaggctgtccacaatatacttcgcatcaccacccctgcatgcacgaatctcggcactcccagagacaatcacagccagcagcccacgccgataccgatcattcacctgggctgagtacaagacgacaatgtactcactccgcctgagccacagccgcctagaactcttcaaaattgacgatgatgacagcgacaatgccagtgagggaaaagcataggaattgctggttaaattgcagacgatgcctatggaccagtggggattaggaagctgaaactgtccccaaaattttggctctctggcagtctggctactatcgtcagatatctcactattatgatggtgtagtgcctaagttgacgggtgtgtaatatcgttagcagtctacagaagctatggttgtacggaagtaatgtactgtcgccttttcagctaactatccatgttctctcttatatgtaatgagttagttgacggatgtgtaatattgctagcattgtatataagctatggttgtatggaagtatgtaatatagccttttcagct

SEQ ID NO: 9065 - DNA, 1833 bp, Allium porrum
gtaaatctcaatcaatttctttctcatttcatcaattctatttatttcctctccgtgttttgctttccgaaagagaatccgttataaaccgtgctccgaaaccaaatctcactttctagataatgggggcgtattccgttgcatcgcctctctgcacgtggctcgtcgctgcatgcatgtcagtcacgtgcaatggagaacgctccttgagatctccgtcgtcacttgcttttgctccttctaagaggagtcggtcgaataagttggtgaaaagaaggggatccaacggtcaggattcgtttggtcttgtttctgcgttttgtggatcgggaattcatttcgatagtctgattagttctttagagccatgtgaagagttctacagatcattaagttttgttagtgatccaaagaagagaagagctgacaaagtgatggcagtagctgtgcaacctgcaaagcaagtagaagagaagaaaatgactgctactaaacagagacgggttgtggtgacagggatgggcgttgtgactccattaggccatgagcccgatgttttctataataatcttcttgaaggagttagtggcattagcgagatagaaaattttgactgtaaagaatacccaacgagaattgcaggagagatcaaatcattttcaacggacggatgggtagcaccaaaattatcaaagaggatggacaaattcatgctttacatgcttactgcaggcaaaaaagctcttgcagatgctggtattagtgaagaaattctgtgtgagctggacaagacgaagtgtggtgttcttatcggttctgctatgggtggaatgaaggttttcaatgatgcaattgaagctttgcgtgtgtcatacaagaaaatgaatcccttttgcgtaccatttgccaccacaaatatgggctctgccatgctcgctatggatttggggtggatgggtccaaactattcaatctcaactgcttgtgctactagcaatttttgtattctaaatgctgctaatcatatcataagaggcgaagccgatctaatgctctgtggtggctctgatgcggcaatcatacctattggattgggaggttttgtcgcttgtagggcactttcggaaagaaacagtgacccgaccaaagcttcacgtccatgggatagcgaccgtgatggatttgttatgggagaaggtgctggtgtactacttttagaagagctggagcatgctaagcaaagaggagcaaagatttatgcagagttccttggaggcagtttcacatgcgatgcttaccatcttacagagccacaccctgagggaacgggtgtctcgctttgcattgaaaatgcgctcgtggaatcaggagtagcaagagaagatgttaactacataaatgctcatgctacttcaactcctgctggcgatgtaaaagaataccaagctcttattaattcttttggcaataatcctaagctgagggtaaattcaacaaaatccatgattggccaccttttgggagcttctggagcagtggaagctgtagctgccatccaggcaattagaactgggtgggtgcatccaaatatcaacttggaaaatcctgaccgaagtgtggataccaaatttcttgtgggttccaagaaagaaaggctggatgtgaaggttgcactatcaaattcatttggttttggaggccacaattcctcaattctctttggccgttacgagcagtgatcgaaaatttttcatgtattctatgttcttttattttgattggttttgttaggatatataagaaatatattccagtcaaggttctatcctgtgt

SEQ ID NO: 9066 - DNA, 1975 bp, Triticum aestivum
cgcctcccggccctcccctccgcggcacatgcccacctcctccgccaccgccgcctcgtggccacgcccctccgcctccccaccaccccgacccctctccgccagcccgccgcgctcccgctccgtccgtgcctcaggcctccccgcgccgcctccgtcgcctcccccgcgccggtgcccggcgatgcgccggacaattcccgcaagttcctcggcgtggacgcgctcacgctcaagaagatcgtgcccctggggctcatgttcttctgcatcctcttcaactacaccatcctgagggacaccaaggacgtgctcgtcgtcaccgccaaggggagcagcgccgagatcatccccttcctcaagacgtgggtcaacctccccatggccatcggcttcatgcttctctactccaagctcgccgacgtgctctccaaggaggcgctcttctacaccgtcatcttccccttcatcgccttcttcggcgtcttcgggtacgtgctctaccctatgcgcgacgccatccaccccacggcgctcgccgaccgcctcctcgcgtcgctcggccccagctttctggggcccgtcgccatcctccgcgtgtggagtttctgcctcttctacgtcatggcggagctctggggcagcgttgtcatctccgtcctgttttggggattcgccaatcagattactacggttgaagaggctaaagagttttacccgctgttcgggcttggggccaatgtggctctcatcttctctggtcgcacggtgaaatacttctcaaacatgaggcagaatttgggtccaggggtggacggatgggctatttcattgaagggcatgatgagcatagtggttgtactgggtttcgtcattgccggtatctattggggagtgaacaagtatgttattgataaaacatctctgccggtcgaacggaagaagaagaataagccaaagcttagcatgggggagagtttgaaggtgctggtatcatctcaatatgtgagggatcttgccacactggtcgttgcttatggtataagcatcaaccttgtagaggtgacatggaaatcgaaattgaaggcacagttcccaagtcctaacgagtattcttcattcatgggtgatttctcaacggctactggcatagctacgtttacaatgatgttgttagggagattaattcttagaaaattcgggtggggagttgcagctacaatcacccctgcagtgttgcttgtcactggagttggattcttctcactgcttctgtttggtgagccactcactcctcttctagccacgtttgggatgacgcctttgcttgcggcggtcttcgttggggcactacagaacattttcagtaagagtgcaaagtacagtttgttcgatccttgcaaagaaatggcgtacattcctttggatgaggacatgaaggtcaaaggcaaggcagcaatagatgtggtatgcaacccattgggaaaatctggaggtgccctgatccagcagttcatgatcttgtcatttgggtctcttgcaaactcaacgccgtaccttggaggaatattgctggtgattgtcatcgcgtggttgggcgccgtaaggtccctcgattcgcagttttctcccctggcaaagcaagacctggagagggaacagcagctgaaagcagaggtagtagaaacgacagctcaagtcgttgggacaggaaacggctcccttcaagaaaatgtcgccagccagagctccacgaacggtacggtcatcaaacagtcgcaagaacccgagattactgcccctgaaaaatctggcaagcagtcttaataagtttccacccccagaaatttagttagtatgagtttttgatggaagcaaacgttgcttggttgggcctgccatgtggagctgctgggaaaggcagtagaatgattgataaggaaaataagatggcctgttcttctgttgttgtagc

SEQ ID NO: 9067 - DNA, 1642 bp, Triticum aestivum
tcccactgcccgccccccacccgcgcgccgccgcggcgatggactcgctccgcctccggccgtcctcgctccgctccgcgcccggcgccgccgccgcccgccggcgagatcatattctaccatcattttgttcgatccaacgaaatggtaaagggcgagttactttgtccatccaagcatccaaaggccctaccattaatcactgtaaaaagttcttggattggaaatattccaaccataggatatcacatcaatcaataaatacttctgcaaaagctgggcaatcgctacagcctgaaactgaagcacacgatcctgcaagcttctggaagccaatatcatcttctctggacgcgttctacaggttttctcggccacataccatcataggaacagcactaagcatagtctcagtttcccttctagctgtcgagagcttatctgatatttcgcccttgttcctcactggtttgctggaggcagtggtggctgctctttttatgaacatctatattgttggattgaatcagttgttcgacattgaaattgacaaggttaacaagccaactcttccactagcatctggggaatactctcctgcaactggagttgcaatagtgtcagtatttgcagccatgagctttggccttggatgggttgttggatcaccacctctgttttgggctctttttattagctttgttcttggaactgcttattcagtcaatctgccgtactttcgatggaagagatctgctgttgttgcagcactctgcatattagcagtgcgtgcggtgattgttcaactggcattttttctccacattcagacatttgttttcagaaggccggcagtcttttcaaagccattgatatttgcaactgccttcatgacattcttctcagttgtaatagcattattcaaggatatacccgatattgaaggggaccgcatctttggaattcaatcttttagtgttagattaggtcaaagcaaggttttctggacttgtgttggtctacttgaggttgcctacggtgttgcgatactgatgggggtaacttcttccagtttgtggagcaaatctctaactgttgtgggccatgcaatcctcgccagcatcttgtggagcagcgcacggtccatcgacttgacaagcaaagctgcgataacatccttctacatgctcatctggaggctgttctacgcggagtacctgctcatccctctggtgagatgaggaccgacaagcagcccacggaagaacttcagtgccggagtacagctgtgcgaatccatttgaatttcggatggtcacggaccgcgcccaataaaactcccagagccttgccccggtacatcgttgattttccagccatgaatggtgagatcaccacctaaagatggataacctccccatgtacccaagctgggccaggtgagctgtagtttagttgatgctagcgagcaacaactcctgcagcaggcacgcggctgcctggaaaataaggctccccactcccaattacattctgttgtacggttttagtacttgtgaattttgctctggtccgttgttgtctaggatgtttggaacattgcgcagactttcttatatcttaccgggaggggtgaattggc

SEQ ID NO: 9068 - DNA, 2027 bp, Zea mays
ctcgaggccggccgggagcccagcttgcctgccacctggtcttgaccctctcctggataggaggagcagcagccagagggacatcaaactgtgctgcctgcgtgtgtgtcttctttcttgcctctcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccacagcagttccaatgatacatgacaccagcagcagcagagcatccacggcgtgccactactcgccgtcgcttgtggcagaggagcagcttcacggctccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcatgtacggagcttctgaatttattagcagtgaagaggatgatgatgattctatttcggagagctcttcagcatcattggccaaaccagctggaactttggatcttggcaagctgacagaggaaccacagttggatgtaccacagcctcaccgccgcagtgtggatccaaaccattcgtatgatcaagtgtttattagatccactcggttactggagaggagatccaagaaacgcaacggcggccacagggctttggataatggtgtggcgtgcagtggtgtgaactcaaagagaaaagacaagtttggcagagttcttgatccagacgagccttttaggttgtttctacgggatcgagagacgacagagttcttgacagcgaaagaggagaaacagatgttcagtcaaatacaggatcttatgaagctggaggaggctcagcgtaacctgcaagctcagtgtggtcgtgaaccaacagttgaagagtgggctcaagccgtaggaatgagctgcagggagctgcaatcctgtgtgcgcaccggaagacggtgccgagagaagatggcccgctccaacttccgccttgtgatacatgttgctaggaaatatgaaggatgtggccttgacattcaggacctggttcaggatggatgctgtgggttgatgaaaacctttgagaagttcaacccgagcaagggatgcagattcccgacctacgcgtactggtggatacgccagtcgatcaaaaagtccatcttcaagaattcaagactaatccggttgccggagagtgtgtatgcacttttgaggaaggtgggcaaagcgaggatggaatgcataatggacggggagcagccgacgaacgaggtggtggcaaggcgtgctggcatcacgattgaaaagctggcgaaactgagagcgaaaaccaggaaagtacggtccatgcaggatcgagtctggtcagacgacggtgtgacataccaggagatcaccgaggaccccaacattgaaggtcctgaggtgagcgtggacaggctgatgatgcggcagcaggtgcgcagcttcctggcggggatcctgagcccccgggagaaggagatcatcgagcaccggttcggcatccacgacggccagcccaagaccctgcatgtcatcggcgacatgtacggcctgtccaaggagaggatccgccaggtgcagaacaaggccctggacaagctcagaaacagcatctcagcacagggcttccacgtctactttgatttgctaacttaagactcttcaacacgcaaacattacatgtacaatgacattccattctgccaatgggtatattatgtatagatagaccaagaattcatgtttttttcctttcccttttgccatttgacattcattcatccttgtactcaacaatggatactcatacatggttgtttgaggagcaaagcttactttaaatgtatggatgtacgtttaagtgc

SEQ ID NO: 9069 - DNA, 1196 bp, Zea mays
atcgaggccggccgggtcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatcctcaagcttctcgaatctcaccttgtgccgtcttccaccgctcccgagtccaaggtcttctatctcaagatgaagggtgactactacagataccttgctgagttcaagactggagctgagagaaaggacgctgctgagaacaccatggtggcatacaaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttacgtgcctagaagctagtacctagtgtttgctgctgtctaatgacactatgcaatgtgatctggaccctggtttcttgggtgcgacgcttgtagcagccgtgttatgattatttgtcgggaaaatttgggggctccccatatgagatgctgccgggcaagacctcggcatcccacctcgtttcaggcgggggacgctggagcgtggtccggttgtgttgggaagccccttaaactgttgtcgcttgcattttaaccttttcatcgccgttcagtggtcctaaatctatggctcgtctcagtggtctagt

SEQ ID NO: 9070 - DNA, 1547 bp, Zea mays; identical to SEQ ID NO: 1388

SEQ ID NO: 9071 - DNA, 830 bp, Zea mays
ggccggccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttg

SEQ ID NO: 9072 - DNA, 1496 bp, Zea mays
ccgggaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgatggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatcccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcg

SEQ ID NO: 9073 - DNA, 1943 bp, Zea mays
ccgggcccgtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccggactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgttgtcgtatttatgctgatgctgatggtcggtggtcgattatatatactggaacttctggtgtatgctcttctcttctggggagacgtaatgtaacgaagaagaatgtgtcattgtggcctgtggtacaaaccctgctgtgtatgggcctgtctataagaaacagcgatgagttgtgacgttatgtttctgacagtttatttactaatgagcacatctttgat

SEQ ID NO: 9074 - DNA, 1119 bp, Zea mays
ctcgaggccggccgggaccacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctgatcatgcaactcctgagggataacttgaccctttggacatccgacctcacggaggatggtgctgatgagggcaaagatgccccgaaaggtgatgcaggcgagggacagtaatcttcggagggggtgcaaagttgctcgagccccaatgttttagatgctctatgctgtcgaagctgtgctgtgccattattgtagctgatttcgtctccattcactttttttttcttgttagtaggctggtagtggtcgaattaatttgctttgtgttgccgctagtccatgtggactggtattgttcccctggatttatttggcaagcgtgtccgtgctcgctctagcgttttattgagctttt

SEQ ID NO: 9075 - DNA, 1712 bp, Zea mays
ccgggaaggaaaactagtcaagttccgtttccatacttccggcgcggcggagatcgaatcgagcgcccgccacggcgatggcgactagagtcctgccaccggctctgctctctttcatactcctgctgctgctctcgctctcagcccgcgacaccgtcgccgcgggcgaggatttcccacgcgacgggcgggtgatcgacctcgacgacagcaatttcgaggcggcgctgggcgccatcgactttctcttcgtcgacttctacgccccttggtgcggccactgcaagagacttgcgcccgagttagatgaagctgcaccggtgttgtcagggttgagtgagcctattgttgttgccaaagtcaacgctgataaatacagaaaacttggatcaaaatatggagtggatgggttccctaccctcatgctttttatccatggtgttccaattgaatacactggttctaggaaagctgaccagcttgtccgcaatctgaagaagttcgtttcgccagatgtttctatccttgagtcagattctgcgataaagaactttgttgagaatgctgggataagctttccgatattccttggttttggggtgaatgactcattgattgctgagtatggaaggaaatacaagaaaagagcctggtttgctgttgctaaagatttctctgaggacatcatggtagcctatgaatttgataaggttccagcactagttgctatccatccaaagtataaggaacagagtttgttctatggcccatttgaagaaaatttcttagaagattttgtacggcaatcccttctccctttggttgtcccaatcaatacagagacactaaaaatgctgaatgatgatcagaggaaagttgttctcacaattttggaggatgattcagatgaaaactctacgcaactggtaaagattttgcgatctgctgctaatgcaaaccgtgatttggtgtttggatatgttggaatcaagcaatgggatgggtttgtggagacttttgatgtttccaagagctcacagctgccaaagctacttgtgtgggatagagatgaggagtatgagctagtggatggttcagagagattagaagaaggcgaccaagcatctcaaataagccaattccttgagggatacagagcaggaagaacaacaaagaagaaaatcaccggcccttctttcatgggtttcctgaactctctggtcagcctgaactcgctgtacatccttatatttgtcatcgcccttctgtttgtcatggtgtactttgctggacaagatgatactcctcagccaagacgaattcacgaagagtgatgaaagcttgttgggtttcttgcacctaaagatggctaatctaccgggagattagcttttgtattaattgtacaaaagcttcaactgacgcaagtcgtgaagagtggttttggcaatttggccattcatgctgagtttcttcaatctctattggcgacatcaatttctgcatcctgcctatttgtgtttctgctttgtgcccttcaatttgttctttaatttagagcttagaaattagcctctgcctgtgtattctgggacctgccattccagagtccatttctgtgaaaatatatttattattatcatactctgctaccgagcttttgtacaattaatacaggatatatagactgttctggtgctatgttactcgct

SEQ ID NO: 9076 - DNA, 1647 bp, Zea mays
ccgggaggcccagccaaattttcgttcacctggcttcacccacccgcgtgccctcgccgacaactgagccaccgccgccgccgccctacccccaggtgcccaggtcgtttcggtccctttgccaggtcttcgccggcgacgagcaccagccaccagccagggaatataactttgacctgtaaaatgaggccagttttttgcgggaaccttgactatgatgttcgcatctctgaggtcgagcgccttttcgggaagtatggaagggtggaacgagtggatctgaagacaggaatatcatggagcatatgtgctcttcctggttgatggactggttctacctttactgcctctgcctgagcccccacctcatgcctggtccatctccaggagttcactgtccaccacggcatctgtgcacatggaaacgaccacctcgtgaccgatgtcttacttttacgatcaacactgcatcctcgtaccctgcctgatcaccattccttcgccaatccaaccatgccaatctcatgtctggctggagagtggagataagtggagggtttgcattcatctacatggaagacgaacgtgacgctgaagatgctatcagtagacttgatggaattgattttggcagaaaaggaaggagaatcaaagttgagtggaccaaggaggatcgcactgctgatcgaagaggcaactcaaggaggtctccaaccaatgcaaaaccgaccaaaaccttgttcgtgatcaactttgacccgatcaacacgagaattcgagatctggagaggcactttgataaatatggcagggtcgcgaatgtaaggatcaaaaagaacttcgcctttatacagtttgaggcgcaggaggatgctactagagcattggagggtgctaatgggagccatttcatggacagggtcatctcagttgagtatgcgctccgtgacgacgatgaaaaaggtgaaagggcgacgaacggatacagcccagacaggagaggccgcgaaagatccccaggtgcaagacggtctcctagtccttacggcagaggtcgggagagaggtagcccagactatgggagaggcaaggagaggggcagcccagactacggcaggggaggccgcagccctgatggcaggggaggccgcccagccggcggtggcggcggcggcagaggtgatcacgccaggggaggaggacgacgacgcagccctgactattatgaccgcgagcgccgagaagctagtcctggctatgacaggccccccagctgctcacctggaactgggagggacgcgagagactagaaaagcgccccatgcctgtgttgtagaattcaagcatcaaagcctcccgcgtcagatgaagttagagttggtgatgttagccagcaggaaactcgtttacttatgtgcgttagctcgtgctgactttgcaagttagcttaccatttcccatttgcgactccagaatgtaactcgtatggtctggaatggtagctttcaggactcgtttgaacctttcttggagtttttttcttcttttccggctaccttgattgccctgtgcatgcgctgatgaatctacagattgtttcgtctgtcaagtgttccgctgtaatgtaagagacgaaattatttgttc

SEQ ID NO: 9077 - DNA, 2103 bp, Zea mays
aaaagaaactagacgcaaccagtttctctttccctcccgattttctgtttttcttctcttggattgggctcaccctgctcaaaacttcggcggcagcggcagcggtagcggtggcggcgccggctttctccatgaacacggtggctttgttgtccttggcgccgcagctgctcattaagccctccctcacctgtttctccagaaagggcgttggccgctatggcggaatcaaggtgtacgccgtgctcagagacgacggagctgagtttgccaagaacaacaacctggaggccctgttccatgtggatgaccccgggccgagggtccccatcaagaagggcaggttcctggacgtgaacgaggctctcgaggtggtccgttttgacatccagtactgcgactggagggcgcggcatgatcttctcaccatcatggttctccacaacaaggtggtagaggtcctcaaccccctagcgagggagttcaagtcgatcgggaccttgaggaaagagcttgccgagctacagcaggagctggcaaaagctcacaatcaggttcatctctcggaaaccagagtctcatctgcgctcgacaagctagcgcatatggagaccctggtgaacgacaggctgttgccaccggacggagcctctagtacgtccacggcgcagcccacttccttggttccaagcacttcgtccaccgcccgtgtccgagccaagaaaccgccacgtcggggccttaacgtgtctggcccggtgaagccgtacaatcccagcctgaagaacttctggtacccagtcgccttctccagtgatctgaaagatgacaccatggtgccgatagcttgcttcgaggagcagtgggtgatattccgtggaaaagacggaaggcctgggtgtgttcagaacacatgtgctcacagggcttgcccgctgcatcttggttcagtgaacgagggtaggatccagtgcccttaccatggttgggagtactctactgatgggaaatgtgaaaaaatgccatcaacaaagatgctcaacgtgcgcatccagtcattgccatgctttgagcaggaaggaatggtctggatttggcctggggatgacccaccaaaggctacaatcccttctcttctgcctccttcaggatttacagtacacgcagagatagtgatggaactgccagttgaacatggactactcctggataacctcttggaccttgctcatgctccttttacacacacatccacctttgccaagggctggagtgttccaagtttggtgaagttcttaacacctgcgtctgggctccaagggtactgggatccttacccgatcgacatggagttccgaccgccatgtatggtcttgtcgaccattggcatctcaaagcctgggaagctagaagggaagagcacccagcaatgctccacgcacctccaccagctccacgtctgcttgccctcctctaggaacaaaactaggctgctgtaccggatgtcgctagacttcgctccgtggctcaagcatgtaccgctcatgcacctgctgtggtcacatttcgcagagaaggtcttgaacgaggacctacggcttgttcttggtcagcaagaacggatgatcaatggcgccaacgtctggaactggccggtatcatatgacaagctcggggtccggtaccggttgtggagagacaccgttgagaggggctctgaacggttgccattcagtaaccaagctgagagtggatcatagccggccggtgggtctcttaatttcctcctcgtcacatttattcgcgagacgacggccagaattagttacctaggcgtgcgtctctgtgctctgctccctgatgctgctgcgtctatctggaaggcgaaggttgatgggtaacatcatcgtgtctctctctcccctctggtgttggaatgtacactagcgtcgttatcatgagatgcaattgtaatctgaggttgatattttctttctttctttctttttccttttcgctttcttcttttcttcaccctttttgtgtaaagattcagcgaatgttactttgtcaaagcatgtataatcaatcatactactaacc

SEQ ID NO: 9078 - DNA, 1705 bp, Zea mays
ccggggtctcgtctccctcctccccgttcctgattcgcgagaccggagggaggggtacgagcttcaccgctttcatcccgcccgcgctcctccccagatctcctctccattgccgccgaccttgcccagattcgcgccctcctcgctcatatctgaaagcggctctgattttccaagccgaccgcaggagcggtgcaccgcgccgcgtgattccggcggcttgatttggaatttgtgatctttcggggcattcgtcggtttgtctgtcggtgccggtggtgctgcgtttcgagggcagcgaagatgggcgtcggcggagagaagtttcagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattctttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgcttcttcttggtgttggtgttgcaactgtcactgatctgcaactcaatgctgtgggatccatactctccttgctggcaattatcacgacttgcattgctcaaattatgacaaacactatccagaagaagttcaaggtctcatcgacccaactgctctaccagtcttgcccttatcaatcactgaccctgtttctcattggccccttccttgatggttttttgactaaccaaaacgtctttgcttttaattatacatctcaagttgtgtttttcattgtgttgtcatgcctgatatcagtctcagtgaacttcagcacttttcttgtgattggaaagacgtctcctgttacttaccaagtcctgggccatcttaaaacatgccttgttcttacctttggttatgttttgcttcatgatccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctaccgcttgacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaagattgccagatatacattgaaactagacggcagatattgtatgattgtatctggacatgttccacatcgtctaactgtaacttccaactggtacatgataaaaaaaaaaaaaaaaaagcggccctcgactccagcttttatactgttcagtgagatggctta

SEQ ID NO: 9079 - DNA, 2167 bp, Zea mays
actccttggggtaccctcgaggtctgccgggtaaaccaaaaccctaaaacccatctcctcctctcttttcccctcccttttccagcacggggagcgacctgcgccgccgccacgatgccgaagcactaccgccctgcgggtaagaagaaggaagggaatgcggcaaagtacatcacgaggaccaaggcggtcaactacctgcaagttagcctcgcaatctttaggaagctatgcattctaaagggtgtctttccacgtcagccaaagaagaaggtggaagggaaccacaagacctactaccacacaaaggatattgcattcctcgctcatgaccctttgatcgagaagttcagggagattaaggtccatcgaaggaaggttaaaaaggctgttgctaagaaaaacagggatcttgcagacaggctgttgaatcggccaccaacttacaagcttgataggcttgtccttgaaaggtatccaacattcgttgatgctcttcgtgacttggatgactgccttacaatggtgcatctgtttgcggcattacctgctgttgacggtgaacgtgttgaggtcaaacgaatccataactgccgcagccatgaatggcaagcatacatatcccgaacccattctctgaggaagacatttatttccgtgaagggcatatattatcaggctgaagttcaaggacaaaagatcacctggctaactccgcatgctcttcagcaagtattaactgatgatgttgatttcaatgtgatgctttcttttctagaattctatgagactcttctaggatttgtgaacttcaaactctatcattcaataaatgtaaattatcctcctattctggatccacgtctggaagctttagctgctgagctctatgcattgtgccgatacatgtctgctggttccagaagaatgattgggaattcacaaactggcgaagtaatggaagataaggatgagaaaagtaaagctgaggaagtaattaaggaagagaaggttgtgaagaataaagcaagctcaaaagcagatgaatctgagctcagattagcacagcttcaacatcagctcccaaccaatgaacctggtgcactgatgaatcttgtagaagaatcaactgccgatgatgcagatgatgatgatactaaagattgtaaaggtttatttaagaacttaaagttctacttgagtcgagaggtgcctagggagtccctgttttttataattccagcgtttggagggactgtttcatgggaaggagaaggagctccatttaaagaaatagacgaagatatcactcaccagattgttgataggccgacacaaagccatgttttcctctccagggattatgttcaaccacagtgggtctttgattgtgtaaatgctcgtatcatattgccaacagaaggttatcttgttggaagagtacctccaccacatttgtctccttttgtggacaatgatgccgagggctacatgcctgagtatgcagagacaataaagaggctccaagctgctgctcgcaatgaggtgttgcctcttccaggtattggtgatgaagatctagacaactcactggtagcagcaatgatggatcgaacagcttctaacgaagctgctgaaaagaagaggaagctggagatgctagagaagcaatacatcgatgaactgaagaaggaaattgatggcgttgctttctctagtttgtcaaacaaggaagcagataaatcaccgaatgcaaaagatgatactcagtcagatcgtgaggaggatgccagtaaacaagaggaggatgatgatgatgatattggtactgctctcatgtctcgcaagcagagaggcctttataaggctatgaagatgggcaaagaaaagaaaaaggagaaagttgagctactcaagaagagaaaaaagaacgcggattctggcgcttcttccaagaagcggcactgatgtgtcacaaatcttcatcgcattggtgtgtcatctctagtagaaatgttaccatgatcagctctgcgtgccaatcccccatgatgggtgggttgccttttgatatctgctatgtatgcttaagatgagttcaaggatatgtaacatgaaacttgaatagaaaagttttgatctgtcttacgaagcatttagactcatt

SEQ ID NO: 9080 - DNA, 872 bp, Zea mays
cctcgaggccggccgggcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggtt

SEQ ID NO: 9081 - DNA, 1655 bp, Zea mays
aaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatatatgcatgtttcg

SEQ ID NO: 9082 - DNA, 1275 bp, Zea mays
ctcgaggccggccggggttccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtggactgagagatggagttttaatttcaaatagcatctagaggactgccactaagcttttaagttggtatataatgggtggctgttgttgctgttcgtcgagaacatctgaagcagttagagcacgagcaccagttgatatatatcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggttttggaaactctgtaggtttggagaagccagacactaagagcaaaactgatgaccaacaagagtccataaatgatcaggagtctttaaaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccagattactttggtggatgagatgttcgaataggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtt

SEQ ID NO: 9083 - DNA, 1974 bp, Zea mays
taccctcgaggccggccggggccgtgccgtgcagtgccatcctccctccattgtttcccggctctccgtcccttgggagttgggccttggcatttccttaagataaaaaaggggggaaatcggcttcctactccccgtccttatcgccagccgaaccgacattgttttctccccccttctcgccttctccttctcccccctagtctagaggcgtttgctccccaatcccttcggcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccatttgcaggagaactggagaatagtagatttcttctctcaccacccagagagcctacacatgttcacctccctctttgacgatgttggcatcccactcaactacaggcacatggagggctttggtgtcaatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgccccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacacggagcgtgtgatgtttacaccaatataattgaataaacaggggatgtgcgcgttgtcgtacttatgctgatgctgatggtcggtggtcgattatatatactggaacttctggtgtatgctcttctcttctggggagacgtaatgtaacgaagaagaatgtgtcattgtggcctgtggt

SEQ ID NO: 9084 - DNA, 1264 bp, Zea mays; identical to SEQ ID NO: 2788

SEQ ID NO: 9085 - DNA, 1491 bp, Zea mays
tttagccacaaatttcacccaaaaccaaaaaaataataatcccaaattaaagaaaaggagcagaagaaaaacaactttcatcgccgtccgccaccggagctcacttcgtcggccttccctcagtgtcaacccccttctcaaaacttgtatttgcacctcagtccctgccggtctgcccggtcgccgcctcgccggaggaagcccctcgtctccttgccctgcggcgggttcatggggttctcgctgtaccccatgaagacgtccacgcggatgctctggagcactagcttcttccgccataagctcagctcctcctcctgcttcctctgaggacgccccacccgcctcgatcgcttcggcggcgggccgctgctgctgcgctgtcctagcatccgttcaagtgtgtgtttgcgttcttaggtttcaagattggcttttgttgcgttcttggcgagacgaagggactagggcgcggacaaagaatcagcatgcatccgagcgcggtcagtttcgactccggcgacgggcggcggcgcggtggcgcgcagatgctgctcttcggcggcggaggcagcgccaacagcaacggcttcttccgaggtgttccgatggcggtcctggccatggacgacgcgacgcgcgtgggcaagcggcccttcttcacgacacacgaggagctcctggaggaggagtactacgacgagcaggcgccggagaagaagcgccgtctgacggcggagcaggtgcagctgctggagcggagcttcgaggaagagaacaagctggagcctgagcgcaagaccgagctggctcgccgcctggggatggcgccccgccaggtggccgtgtggttccagaaccgccgcgcgcgttggaagacaaagcagctcgagaccgactatgaccgcctcaaggctgcctacaacgcgctcgccgctgaccaccagggcctcctggccgacaacgatagcctccgggcacaggtgatctgcctaacagagaagctgcaaggcaaggagacatccctgtcggcaaccatcgctgcccaagaggtcgaccagccaaacgaacacaccacaggcactgagaaattgctggcgcagcagctcaaggacgacctgcacagcagctgcggttgcactggacatggtgccctgtcttcggaggaagaggatggtggcgtggtcagcgatgagggctgcaactttgatctccccgacgccatgtttgctgttggggtcaccaaccatggtgctgaggaggcgcagctggccaactggacatcttggttctggaactgatcggttgatggatggatgcatcaagtgcaaagagcaaatcctctcctggtttcgactcttttctgcaacatataattactgtgttgattatgtgccgtcagacgttttcaagtaatgaaacagaactgatgttgtaagtttatgtttctgaagatttgtatgttcatatatataataatatgctttgaac

SEQ ID NO: 9086 - DNA, 1252 bp, Zea mays
aggtcaccagttcggtcctgcgctctcgagtcgagactccaccttccattcatttcatctgctccatctctctctttgttcgccggcgtataataagcttcccctttctgcaactgatctgatccgggctgccgtgagctctgctcgccctgatggagttcaagagggatgtatggagcctgctcctcgtgctgctcctcgggcagctcgtcgccttctccatggccgcctcaagctttgcctcctccctcattgctaatcttggagtcgatgccccactgacacagtctttcttagcctacctgttgctgaccttagtctatgtaccaatcgtcctgcgtcgacggcagaagctgcaaatagcttggtactggtacctagctctggccttctttgatgtacaggggaattatcttgttgtgaaggcgtaccagtactcatacattaccagtgtgactttgttggattgctggactgttgtatgggtcgtcatgctcacctggtacgcactgggcacaagatactcactctggcagttcgtgggggcagggacatgtgtggcagggctcgcccttgtgctgctttcagatgcaaaatctcaagatgagcaagatccgaaaaaaataccacttctgggggatgcccttgttattgctgggacagttggttttgcgtttagcaatgttggggaggaatactgtgtcaagaaaaaggatagagctgaggttgttgcaatgcttggtctctttgggttgctgatcagcacagtgcagatacttgtatttgaaaggaagggcctagaagcagttacatggtctccaacaatgataagtctgtttgcaggatttgcagtggcaattttcgtattctacacagttgctcctttcgttcttaagatgagtggagctacattgttcaacctttcactgctaacatctgacatgtgggcagtcgccattcgagttttattctatcagcaagagataaacaggttgtactacctagcattcacagttgtggccattggattaatcatctattcgttgaatgatagatcttcagatgatgaaacagctggaagtacagaagcaccagcccaatatcagcaacttccaattgaagacaattcaacaagaattggttctagttcaggtagccaagaaaggacacataaggaagaagttcatatctgttagtgggataatgtattaatgtacgaagacacttcattgtcaatgcatggatttttact

SEQ ID NO: 9087 - DNA, 805 bp, Zea mays
ccggggagcttatcacttatcatccccatccgcacctctctccatctccctgctcctccgccttcttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggtcatgccaaatgccactttgttgccatagatatattcaacgggaaaaagctcgaagatattgttccttcgtcacacaactgtgatattccgcatgtgaaccgtactgagtatcagctgattgatatatcagaggatggatttgtgagccttcttacttcagatggcaacactaaggatgatcttagactcccaactgatgagactcttgtggcccagatcaaggaagggtttgaaagtggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatgtcaaacacaagtgcagggatcgctgggtgttgcaccgtgtctgcattatctgtggttacattctggaccctgtattttctatgcttttatgcccctactgtttagtattaattatcaataaat

SEQ ID NO: 9088 - DNA, 979 bp, Zea mays
gtcgccggcgccggcgattcctcctccaccgattcgcccggcgggagtctccgcagggctcaccgggaccgcgggtccacgatggccgccaacttctggacgtcgtcgcactgcaagcagctgctggaccccgaggacgtggacctggtgccggcggcggaccgggagcgaggcatcacgccggaagagttccgcctcatcaagatccatatgtcgttccatatctggaggctagcacagcaggttaaagttaggcaaagagttgtagctacagcaatagcttacttcaggcgtgtgtatacaaggaagagcatgtcagactatgatcctcgtttggttgcacctacttgtttgtatttggcatctaaggtggaggagagtacagtgcaagcccgacttcttgtattttatataaaaaagatgtgtggttccgatgataagtatcggtttgaaattaaggatattcttgaaatggaaatgaagctcctggaagctctcgactattatttggttgttttccatccatatcgtcctctcttacagttgttgcaggatgctggcataacagacctgacacaatttgcctggggccttgttaatgatacatacaagatggaccttatcctcatataccctccctacatgattgcactggcctgcatatacatagcgagtgttttgaaagataaggacaccacagcatggtttgaagagctccgtgttgacatgaacatagttaagaatatctctatggaaatattagacttctatgacacctacaagattgatcctcaaaggggcatccctgaggataagataagccccgtgatgaacaagttgccggcaaaggcttaactcagatttggcgagcttaggagttgtaaactagtagtaaactacatcatacttccaccatgtgtgtactcagcctgcactgtcgcttgagacgtgttgatgaactacttgatagattcgatgc

SEQ ID NO: 9089 - DNA, 1449 bp, Zea mays
ctcgaggccggccggggcagcttcagccaccaagagaccagggctgaactgctgaagctgagataggattgagaatcgctgccagtggaaagcggcactagcagcagggcagaagcaagaaccagcaagaaaggggagagagaaagcggaaggactttttctcggattggatccttcgcttttgggggaaggagaaggcccctctctgtcctctctccatccttgcggagggcgctagcaggagcagcggaaggaggaagagatgttcccgcctggcctgatccaccaccgccctgacgcccccgttcccggcgatggggcgacacgctccggccccggcgggccgagccttgtactgacggcggaccccaagcccaggctgcggtggacggccgacctccacgagcgtttcgtcgacgccgtggcccagctcggcggacccgagaaagcaacaccaaaaactatcttaaggacaatgggcgtcaagggtcttactctttttcacttgaagagccatcttcagaaatacagattagggaaacaatctggtaaggagggatcagagcaatctaaagatgcatcctatcttctagatgctcaaagtggaatgagcgtgtcccctagagttcctgcccaggatatgaaagaaagccaagaagttaaagaagcactgagagcgcagatggaagtccaaagaagactgcatgaacaagtggaggtccaaaagcgcgtgcagatcagaatggaagcgtttcagaagtacatcgacagtatcctggagagcccgtgcaagatggtcaccgaacagttcgcttcaagtggcttcagcatctctgaccctgatctcccggagatatcccctggaggggtggtcatgtgtggcggccccacggacacgttgagctcgtcggtgttcaaccagctttccgtcagctccatcggctcgcacagtccaggaggcaaaccttccccttccccatcaggcatggaatgtccgccgctgctcctccacaagtcgcatgagctcaagcggaggtcctcttgaactgacaaatcggcgaagcctgagggcgcggtgatggctgtctttgctagtgttgtcggatatggtggtactggtggtgacaagggaaattggtggtccagtcttgtggtagctgactttctccaggtagcaagatattgctgtgtttgtttgatcagtcaaagcatcaaacagacagacctacgttcatgtgaactgcctcatgcatgtgctagattgaaaaaaaaagttatcatattttgtcatgagattatgattctactagctagcatccttagcacacttgagatgttgttgactcgtgtcctagtgtcctctgtgttgatccatgtatgcacagcgattcatgttgggagttgggactgggacatgttaacaccagatgtttcaagcttcgtacttag

SEQ ID NO: 9090 - DNA, 1343 bp, Zea mays
ccgggaccgtggtcttcgccaaaccgctttccttcccatctaaaaccgccccctcccttcctcttctcctagctctcttgcctgcgcaccactcgagtcgagactcgagaggcacctgatctttccttcccgtcttcctcccacacgtcccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcacttcagaagagtcaaaggcagctgttaggagaacaattgagttcactgaccataaaagaactccagcaactggagcaacaactggacagttctttgaagcatattaggtcaagaaagaatcagctcatgttcgattcaatttccgcgcttcagaaaaaggagaaagcacttacagatcaaaacggtgtcctgcaaaagttcatggaggcagagaaggagaaaaacaaggctttgatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccctagatatcaaccgatgcacgatccatctcgatcctgtgatcgaataccggcgtaggtactaccaataaagtcaggccccgtcaaatgctttacatggtgattgaagtctggagcttctcagcaccaccatatattgtgttcagttcctgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 9091 - DNA, 1048 bp, Zea mays
ccggggcaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggc

SEQ ID NO: 9092 - DNA, 1175 bp, Zea mays
accccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctataac

SEQ ID NO: 9093 - DNA, 835 bp, Zea mays
ggggaagcttatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccggattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttg

SEQ ID NO: 9094 - DNA, 1252 bp, Zea mays
ctcgaggccggccgggagggtttccccagagttaaaaggcccggaggaggcgcccctataaacccttcccttctgtcgctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatatggtcttgaagttggtctgaccaactatgcagctgcctactgcactggccttctgttggctcgccgtgtgctcaagacccgtggtttagataaggaatatgagggcaatgttgaggccactggtgaggacttctctgttgagccagctgatgagaggaggcctttccgtgctctcttggatgttggccttattaggactacaactgggaaccgtgtctttggtgccctcaagggagctttggatggtggactggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagtttgtcgatgcgaacaaagttgtttctgttagtttggagctggagttctgaatatttacttttataatattaaaattggaccgagttgaac

SEQ ID NO: 9095 - DNA, 1111 bp, Zea mays
ccgggacagcatccgcagttccccgaccacaccgttcctccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaaccttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggaatcttgaagctgcttgactcccacctagtgccttcttctactgctgctgaatcaaaggtcttctacctcaagatgaagggtgactatcacaggtatcttgcggaatttaagactggtgctgagaggaaggaatctgctgagagcacaatggtggcctataaggctgctcaggacattgctctggctgagctggcacctacccatccgataaggctgggacttgctcttaatttttcagtgttctattatgagattctgaactccccagacaaagcttgcaacctggcaaagcaggcgtttgatgaagctatctctgagttagacagccttggtgaggagtcatacaaggatagcactctggtcatgcaactcctgagggataacttgaccctttggacatccgacctcacggaggatggtgctgatgagggcaaagatgccccgaaaggtgatgcaggcgagggacagtaatcttcggagggggtgcaaagttgttcgagccccaatgttttagatgctctatgctgtcgaagctgtgctgtgccattattgtagctgatttcgtctccattcacttcttttttcttgttagtaggctggtagtggtcgaattaatttgctttgtgttgccgctagtccatgtggactggtattgttcccctggatttatttggcaagcgtgtccgtgctcgctctagcgttttattgagcttttaaagtc

SEQ ID NO: 9096 - DNA, 1341 bp, Zea mays
ctcgaggccggccgggacaaaaggcgacgcgaacacaggagaggggagagcccgagagcttcccttgccggcgagatccagtccggctcacgcgatctgactttcccagaggtccttgaatgtgatcgcatcattgcagcagatccaggttaagcagatggctgacaacagcattgagcaagcattgatagagaatcctcctaatgcgctgaaatggaagccatcagaaagagctaaacggtttcgacgatgcaggtcaactccctcagatcccaccgatcaaaaacctgcagaaaacggatctgtgcttaaagccaaagagttattcaaggagaaaaggccgagcttcatgcttgtaggcctcctccttttcgcctacctactagtgggtgtcatcatcttttacctattcatggatcagttatctgggaagacaactgatagagtgcttgacgccttgtacttcgttattgtcacaatgacctcggttggctatggggatcttttcccaaacagtgacacaacaaagctgcttgcatgcgcttttgtattcacaggaatggcgatcattgctctcttcatcagcaaagcggcagattaccttgttgagaaacaggaggtgttgttcttcaaagcactgcacatgaatatgaagggcagcgaggccaaaatgctaggagcaatggaaacaaataggataaagtacaaattctacactgtcgctctgcttcttgcaatggttattgttgctgggactgtatttctgtggaaggttgagaagctcagccttgttgattccttctactgtgtctgtgccacgatcactaccctgggttatggggataaaagcttctcgtccaaactggggcgtgtttttgcagtgttttggataaccacaagtactctcatcatggctcagttcttcatgtaccttgctgagctctacactgagcgccggcagaaaatcctgaccaaatgggtgatcaacaggaggataaccaccatggatcttgaggcagctgatatagatgacgaccgacaagttggtgctgctgaatttgtactttacaagctaaaagagctgggcaagatcagccaagaggagatatcttgttttcccgaggagtttgacaagcttgatgttgaccagtctggcacactctcaacttacgaccttactctaggacaaaccagtcaatgactgatgatgcatatgtgattttgctgactgaatgattttgtttgatgtcgttagcatttctgttgtccatatgtaacacgctataatgttgtaaagatgtaaattaagatgattgagaaattgtgccccaccttctctcc

SEQ ID NO: 9097 - DNA, 827 bp, Zea mays
ccgggaagcttatcgcttatcatccgcgcctctacatttcttctctctctgctcctccgcctccgcctccgcctgatccatccaagacagggatcgccatgtcggactcggaggagcaccacttcgaatcgagggccgacgctggggcgtccaagacctacccgcagcaggctggcaccgtccgtaagaacggcttcatcgtcatcgagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactgaggatgatcttagactcccaactgatgagactcttgtggcccagattaaggaagggttcgaaagcgggaaggatcttgttatgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttg

SEQ ID NO: 9098 - DNA, 936 bp, Zea mays
ctcgaggccggccgggatccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttggtggtgtctactactatgtctactttatgttgtcctaatggttgtaagtattttgggagtcactttgcttgcgtatgtctcgcgtaagacttatgttggtcaatggtcggttattaacttattaccatgaaggcacttcgtctgctgccctaagaggtttagtcccatttgcattataaccaattcaatccttgtggatgatttgtgtgattccatcgtgaatctcatggtaaaatattttcattgttgc

SEQ ID NO: 9099 - DNA, 2070 bp, Zea mays
ggccggccgggtctctcctcgccgcgacgctgccgtgttcgcgattcagcgccgtgctcgacgcccctcctcccttcagaagtcagcgccgcatctccggttgcagagacttgcgctgccacctctccgcttttcgtccttcagttgctcgacgcccctcctcccctcagaagtcagcgcagcgtctccactctccacgccgtcgcgtcggcgacgcgggtccttcgaataagacggtttgttctcgcatcgggcgtcagccggattcgagggacatagatgatggaagtcgatcttgggtgccaccacgtcgaagcggcttgtgctgtgtagatccggcgaaagcgcgcaggcaaagcccgggtctgcgtcgtcattggcctcatgatcttcgtattgccatcgcgctaaagggaacgaaggcgacgaggtcttaaactttgattgatgtatgcggatatgaaaatgcatgcaactacatgctagaagtctgtcttggttgtgttggagaaaaattctttgttacgtttttgttgatagtgttgagtgccaaaaatggagcttctccctgttgaagtcgttggcaacattctttcccatcttggtgttgcgcgtgatgttatgattgcctctgcggtatgccgcaagtggcgagatgcatgcaggaggcatctccgtttgctgtccttcaactccaatgactttccacgggacatgactacacgtcagttggagattgtcatcacacagactatatttcagactattgggctgcaacgcctttcgattcacattgataacacccatgagttctctgcagcaccagtgattgcatggctcatgtataccagggagaccctccgaagcctgtcttacaatgtcaggacaatacccaatgtaagcattcttgaaaagtgtggtaggcaaaagctcgaagtgctagatttggaattggaccataacaccatcacaggtgttgaaccaagctatcagaggttcacttgtctgaaatccctttccctgaggcatgtcagcattttggccttggatttgagccttttagttgctgcttgcccaagaatagagtcattagcacttgatgtccttgaggttgtcacttcagaattacagtctacgatggagctcacaagccatacattgaaaagtctatttgcaaaatcggtaggtgtagataagatcatacttgatgcagataatttggaagttctgcacctgaatgctttaaatctcgatctgtttgagcttaacgggaaaggaacactaaaacattttaagattgatgatgtcagtgttactcatttggatattggggacaatactgatcatttagaggcagtagacgtgagcaacttcacaatagtctggccaaaattctatagcatgatatccagggcatctaatttgcgtatgctacgattttggggtgttgtgtttgatgacgaggatgagatcgtggattcagaaactatagctgtttcatttcctcttcttaggcatctttcattgagttatgaattacgagatgggttacttcactacagccttcagggatcatcattactggagaatgtctcagttctggaacttggttggacagtaataagtgagcactttggaccctgggtatttggtatgattggaaggtgtccaaatctcaagaaacttgttattcatggtgttctttctgagacaaaaacgcgagaggatcgccagatgttagcaagctttacctcattcatagtctgtgtcatgaggaagtatgtgcatgttgatgtacaatttgagtatgagtgacagctactaggttgggtgggcatcttgtcattgttcagatgaagctgtgccatcagttgcttgatactgggttcttccacattgatccacatctaggcaatatgatcagaacacctgacggagattatgttgcagaactgtatcaactccctctaattttatgttatattatatttggtaggaatttctactgggtctgaaacttgtaacatacagttttctgaagatctacgaaagatagtggatacttatcag

SEQ ID NO: 9100 - DNA, 1749 bp, Zea mays
ggggatgccctccttgtcctggatcttggccttcacattgtcaatggtgtccgaggactccacctccaaagtgatggtcttccccgtcagagtcttcacaaagatctgcatcttggcggcgatggggggccgcctgcggcggcggctaggtaggttcttgctgcctcccttagctcgtagtctagactctagacctctatatatacagtactcgtccccgttttcttcctcaccaacttctcatcatcagccaagtgtaaagggtgcgaagaagcagtagcaaaaaggattccattctcgtgttcttggagtggtccatcgatcgagctccgtgagagagagagagagagagagagagagagagagagagagagagagagcaagcaatggcgacagcagggaaggtgatcaagtgcagagccgccgtggcgtgggaggccggcaagccgctgtccatcgaggaggtggaggtagcgccgccgcaggccatggaggtgcgtgtcaagatcctctacaccgcgctctgccacaccgacgtctacttctgggaggccaaggggcaaaccccggtgttcccgaggatcttaggacacgaagcgggaggcatcgtggagagcgtcggagagggcgtgaccgagctcgcgccaggcgaccacgtcctcccggtgttcaccggcgagtgcaaggagtgcgcccactgcaagtcggaggagagcaacatgtgcgacctcctcaggatcaacgtcgaccgcggcgtgatgatcggcgacggtaagtcccgcttcaccatcagcgggcagcccatcttccacttcgtcgggacgtccaccttcagcgagtacaccgtcatccatgtcggctgcctggccaagatcaaccccgaggcgcctctcgacaaagtctgcatcctcagctgtggtatctcgaccggccttggcgcgacactgaatgtggcgaaaccagccaagggctcgacggtggcgattttcgggcttggggctgtaggccttgctgctatggaaggtgctagactggctggtgcatcaaggatcatcggcgtggacatcaacccagcaaaatacgagcaagctaagaaatttggctgcactgaattcgttaaccccaaggaccacgacaagccagtgcaagaggtgctgattgagctgaccaacggcggcgtcgaccgcagcgtggagtgcaccggtaacgtcaacgccatgatatccgccttcgaatgtgtccacgacggctggggtgtcgccgtgctggtgggtgtcccgcacaaggacgaccagttcaagacccaccccatgaacttcctcagcgagaagacactcaagggcaccttcttcggaaactacaagccccgcaccgacctgcccaacgtcgtcgagatgtacatgaagaaggagctggagctggagaagttcatcacgcacagcgtgcccttctcggagatcaacacggcgttcgacctgatgctcaagggggagagcctgcgctgcatcatgaggatggaggattagagcttcattgcaagcttgctcctcctgcagggcaggcatgtcgcacagcaaatgggcatgaaaagttgaaggcgctccagtcctccagcttgtgtagtacacagtagcaataaaacgttagtgtttgtcctgtgcccatcctgtattattctgttccagggtttcacctttatcgtcagtgtgtggtcaggtttcaacccttctcagaacaaccccctcccag

SEQ ID NO: 9101 - DNA, 757 bp, Zea mays
ccgggcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttg

SEQ ID NO: 9102 - DNA, 2271 bp, Zea mays
ccggggaaagagagacgtaacgtaacaacctcggcttctacggcgtagcgtaggaggcggcggttccaggcgaccatccaataatcgccaccctcacgcgagaaatccccgaacacatacgatttctgccagtctgaagttttggactttatgtgagctgttgctaattcaactgcttctgctacacgatccattaactgctttccgatccgtgttctgtgaagtttgccctcttcctcagggccaatttggcaacttgtcagaacacacacggtttcggtcagtctgaaggcaacttttggggaactacacgtgtatggagttttattagtattccaggggcatcacaatggcatactttcctgatgaagtagtagggtatatccttggttatgtaacgtcgcatcaggaccgcaacgcggtgtccttggtctgccaggcatggtacgacattgagcgtcatggccgccattcggtgcttgtaagaaactgttatgcggtgtgcccagagcgtgtacatatgcggtttcccaacatgcgtgcactgagcttgaagggcaaaccgcactttgctgaattcaaccttgtcccggcgggttggggtgccactgcaaatccatgggtggatgcgtgcgcccgtgcatgcccaggtcttgaggagctccggctgaagtttatggttgtgactgatgaatgcctcaagttgctttctctatcctttaccaactttaaatcacttgtccttgtttgttgtgaggggttcagtactaccgggcttgctaatattgccaccaattgcaggtttcttaaggaactagacttacaaaagagttgtgtgaaacatcaagaccatcagtggattaattgttttcccaagtcttcaacatcactagaatgcttgaatttttcctgcttgactggggaggtgaatgctgttgcactggaggaacttgttgcaaggagtccaaatcttaaaagtttaaggctgaatcttgcagttccatttgatgttttgtccagaatcctttctcgcacacctaagctagaggatttaggcacaggatcctttttacaaggcaatgaccctgctgcatatgccagtttatgtagagctcttgagaactgcacttcactgaagagtatatctggtttttgggatgctccaggcttttatgttcaaggaattttgtcaaattgcaagatcagaaatcttacatgcttgaatctcagctatgctacattgattcagagtacccagcttatcggtattattcgtcattgtaagaagctccatgtcttatgggtgttagatcacattggtgatgagggcttgaaggctgtgtccttttcttgtcctgatcttcaggagttgagggtatatccaagtgttgttgcaccaagaggtactgtgacggaggaagggttggtagccctatcttcgtgtcggaagttacagcatgtgctcttctcttgtgttcgaatgacaaacacggcgctgatgacaatagcaaggtactgcccacggctaacgtccttcagactatgcattcgcaagcccaggtcagcagacgccgtcacaggacagccactggacgaaggctttggggcgatagtgcggtcctgcagaggcctgaggcgtcttgccatgtccggcctcctcacggacagcgtgttcctgtacatcggcatgtacgcggagaagctggagatgctctcggtaacgttcgcgggggacaccgacgacggcatggtctatgtgctcaatggctgcaggaacctcaagaagctggtaatcaaggagagccccttcggtgacgccgctctcctcgcgggcgcgcacaggtacgagtcaatgcgcagtctctggatgtcgtcctgccagatcaccctgggtggctgcagggcccttgcggccaccatgccaaacatcaatgtcgaggtcatcggtggggcgagctttggtgcgatggatggtggtgtcagcgatgcgaggaaggtggacatgctctacctctaccgtactctggctggacctagatgcgatacgccaggattcgtctcgatattgtgagctgtatctatggctactgttggtggcgttcagggaaacccgatgttcttaaccgtgcctgctgtgggctgtggctgtgctactctgtctggtagtgtttcggaaacacgatgtttatttgcgtaaggtagtgtttggttctggaaccattttaagccttgttcagatattcctatacctcatggattggaagtgattgg

SEQ ID NO: 9103 - DNA, 2336 bp, Zea mays
ccggggaaaaggttccaccgtctaccttgccccgaccggaactggaacccctaaaaatttccctttcgtacctttccccttcctcctcccgtccaccacaccccggctccaccccgtgcaaatccgctggccgcagcaagagaggtcgaggagggaaacagatcgggtggcggcaaccggtagccggttccgctggcacgatgggcggcgaggccgagggcggggagcggcggctggggcgggtcctgagctttgggatcccggacacggcgctggggctagtgatggggtacgtggaggacccttgggaccgcgacgccatctcgctggtgtgccgccactggtgccgcgtcgacgcgctcagccgcaagcacgtcacggtggccatggcctactccacaacacccgagcgcctgttcggccgcttcccgtgcctcgagtcactcaagctcaaagcaaagccccgcgcggccatgttcaacctcatctccgacgactggggcgggtctgcgtcgccgtggatccgacagctctcggccactttccactccctcaagaagctccacctgcgcaggatgatagtatccaatgacgacatcaacacgctcgtccgcgccaaagcccatatgctcgtgtcgctgaagctcgaccgctgctcaggcttctccacgccctccatcgcactcatcgcccgctcttgcaggaaactggaaacacttttcctggaagaaagcatgattgatgagaaagaaaatgatgaatggatccgtgagcttgctacgagcaattctgttcttgagacactgaatttctttcagacagatctcagggcatccccagagtatcttacccttcttgtgcgcaactgtcaaaggctgaaaaccttgaagattagtgagtgtttcatgcctgatctggttagtttgttccgaactgcacaaacactacaagaattcgctggtggttcctttgaagatcagggtcaacctgtggcaggtagaaattatgagaactactattttcctcctttactgcaccgcttgagtttgctctacatgggaacaaatgagatgcagatactgtttccatatgctgctgcacttaagaagttagaccttcagtttacattcctttccacagaggatcactgtcagatagttcagcgctgccccaatctggaaaccttagaggtgagggatgtcataggggatcgtgggctacaagttgttgcagagacctgcaagaaattgcagaggctcagagtagagagaggagatgatgatcaaggaggtcttgaggatgaacaaggtaggatttcacaggttgggatgatggctatagcccaaggctgccctgagttgacatactgggcaatatatgtatcggacattacaaatgcagctctagaggcggttggtacatgcagcagaaatcttaatgatttccgccttgtccttcttgatagagaagcacatataactgagttgccactggacaatggggttcgtgctttgcttagaggttgcaccaaactcaggaggtttgcattttatgtgagacctggggtcctatctgatgttggtcttggctatgttggagaatttagcaagagcattcgatatatgttgcttggcaatgttggtgaatctgataatggaattatacaattatcaaaaggctgcccaagcttgcaaaaactggagctgaggggttgtttgtttagtgagcatgctttagctatggctgcactagagctcaagtcactgaggtatctgtgggtgcaaggattcaggtcatctccaaccggaactgatcttatggcaatggtacgccccttctggaacattgagtatattcttccagaccaagatgaaccttgcccagagtataagaaacagattctggcatactactcccttgctggaaggaggacagattgccctccatcggtaactccactttacccggcagtttgagcgtagatacttgcttttttccagactgaatctcatggtactaagctccattgctcccacaatctgtgaaatcgatggttcctgttgatggggacatgcagacgttccattgcacataaccccagagctaagctctaagcaggacgacagctcggaactgaggctagctgagaacaatcttgaatacctgaaggcagcactttgtggatcagattggcctagctgtccagtatggaaatgtaaacttcaccattttgaatagttttggagaaacaattttgtaataatttacccttgtttagtgtacattattgattttcgtttatatgatgttgtattgctttatttaacatttaagtc

SEQ ID NO: 9104 - DNA, 2360 bp, Zea mays
taccctcgaggccggccgggtcctctccgctctgctccctccgccgtgcgctccaacgaactccacacgaaattctccgcgtaaagttggggagcagcgaacccgtagcgcgcgccccggatccctccacggggggcaatggcctcgtcggcgttcctgcccgagctgggcacgcaggtggtggtgcccgtcgcggccgtggtaggcatcgcgttcgcggtgctgcagtgggtgctggtctccaaggtgaagctctcccccgagccgcgccgcggcgacggctccgccgggaagagcggcgccggcgccggcgccagcgagtacctcatcgaggaggaggaggggctcaacgagcacaacgtcgtcgtcaagtgcgccgagatccagaacgccatctccgaaggagcaacttctttccttttcaccgaatacaagtatgtgggactattcatgggcatttttgctgtcctgatcttcctcttccttggttctgttgagagcttcagtaccaagagtcagccatgccactacagcaagggcaagacgtgcaagcctgcccttgccaatgctatcttcagcaccattgcctttgtgcttggtgcagtcacctctcttgtttctggtttccttggaatgaagattgccacatatgcaaatgccaggacaactcttgaggctaggaagggtgttggaaaggcattcattactgctttccgctctggtgctgtgatgggcttcctgcttgctgctagtggcctttttgttctttatattgcaatcaacttgtttggaatttattatggtgatgactgggagggcctttatgaggctatcactggttatggtcttggtggttcttctatggctctttttggtcgtgttggtggtgggatttacactaaagctgctgatgttggtgctgatcttgttgggaaagtcgaaaggaatatccctgaagatgatccgagaaacccagctgtcattgcggacaattttggtgacaatgttggagatattgctggtatggggtcagatctctttggctcttatgctgagtcttcatgcgctgcacttgtcgttgcctcaatctcttcatttgggatcaatcatgaattcacccctatgttgtacccactcctcattagctctgtgggtatcatagcttgcttgataaccactctttttgcaactgatttctttgagatcaaggctgtagatgaaattgagccagctctcaagaagcagcttataatttccactgctgtgatgactgttggcattgcacttgtcagttggttagggcttccatatacattcacaatcttcaactttggtgtgcagaagacggtgtataactggcaattattcctatgcgtggcagttggtctgtgggcaggactagttattggatttgttacggagtattacacaagcaatgcatacagtcctgtacaggatgttgctgactcctgcagaactggagctgctacgaatgtcatctttggccttgctctgggatataaatccgtcattatccctatttttgctattgcttttagtattttcctcagcttcagtcttgctgccatgtacggtgttgctgtggctgctcttggaatgctcagcacaatcgctactggccttgccattgatgcctatggtcctatcagtgacaatgctggaggaattgctgaaatggctggcatgagccacagaatccgcgagagaactgatgctcttgatgctgctggaaatactactgctgccattgggaagggttttgcaataggttcagcagccttggtgtctcttgccctctttggtgcttttgtcagccgtgctgagatctcgactgttgatgttctgacacccaaagttttcattggactgattgttggtgccatgctcccatactggttctcagcgatgacaatgaagagtgttggaagtgcagcactcaagatggttgaggaagtccgcaggcagttcaacaccatccctgggctcatggaggcatcctcttcaaatggctttagaggaagaatggaagatggatgggtagtttatttttgccgggggagagcactagatatatgtcatagagaagtttcagtttacccatatggtgcacttcatccttttttgtttcgcttgtactgtgtcgcagtcttgttgaacttgtcagccgtggtatcacctagttgttgggtctagttgcagtagccgagtggagcaaaaacgtctagcattctacaggattggagtttggacatggatgtgttgggaagtttgatactgcatgtagatatttcgatgatgatgatcaaggaatgcacaagtcagatttacctgtgtttgcg

SEQ ID NO: 9105 - DNA, 840 bp, Zea mays
ccgggtatcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgac

SEQ ID NO: 9106 - DNA, 1641 bp, Zea mays
ccgggactctcgtctcgtctccctcctccccgttcctgattcgcgagaccggagggaggggtacgagcttcaccgctttcatcccgcccgcgctcctccccagatctcctctccattgccgccgaccttgcccagattcgcgccctcctcgctcatatctgaaagcggctctgattttccaagccgaccgcaggagcggtgcaccgcgccgcgtgattccggcggcttgatttggaatttgtgatctttcggggcattcgtcggtttgtctgtcggtgccggtggtgctgcgtttcgagggcagcgaagatgggcgtcggcggagagaagtttcagctggggacggtgggggcgctgagcctatccgtggtctcctccgtctccattgtcatctgcaacaaggccctcatgagctccctcggctttaacttcgccactaccttgacaagctggcatctgctggttacattctgctcccttcatgtggcattatggatgaaattttttgagcataagccttttgattcaagaactgtcatgggatttggagtacttaatggaatctccattgggctcctcaacttgagtcttggcttcaactctgttgggttttaccagatgactaagctggcgatcatcccgtgcactgtcatcttagagacacttttcttcaggaagaagttcagtcggagtatccagatgtccctttctgtgcttcttcttggtgttggtgttgcaactgtcactgatctgcaactcaatgctgtgggatccatactctccttgctggcaattatcacgacttgcaatgctcaaattatgacaaacactatccagaagaagttcaaggtctcatcgacccaactgctctaccagtcttgcccttatcaatcactgaccctgtttctcattggccccttccttgatggttttttgactaaccaaaacgtctttgcttttaattatacatctcaagttgtgtttttcattgtgttgtcatgcctgatatcggtctcagtgaacttcagcacttttcttgtgattggaaagacgtctcctgttacttaccaagtcctgggccatcttaaaacatgccttgttcttacctttggttatgttttgcttcatgatccatttagctggagaaacatacttgggatcctaattgcagtagttggaatggtcttatattcatacttctgcacagtggagacccagcataagaacactgaagtctccccacagcaggtgaaagaaagtgaggcagcccctttgatctcagactctttgagcaaagttgaaaatgggggcggtgttgttgatgacgagcctttgaaggtacccatgtggagctcaaagtattcgcgggagtgaaattttctaccgcttgacggtggcatcatacaggattcagtttagtaggcagatagtagggttggaagccaacccagagtgtaatgaacatttgagttacattttttggccttttttagcgtcacgatctactactggtaaaagggtctgtttcttgggaggatcttaccttcaagattgccagatatacattgaaactagacggcagatattgtatgattgtatctggacatgttccacatcgtctaactgtaacttccaactgag

SEQ ID NO: 9107 - DNA, 1547 bp, Zea mays
ctccgtccctccgtcagtccctccgtcaggtcttcgtcggccccctcgccgacgagcacccaccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgagaaaacctcattcatgttatttcttaacaaatttgacatatttgagagaaaaatacaaaaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagatattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctttttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgtcg

SEQ ID NO: 9108 - DNA, 1173 bp, Zea mays
ctcgaggccggccgggcccgcaactgcagatccccaattcgtttatttcttcccaccgagccaagctgcgacgacggcggtcgcagcgtcgccttccctccctccgtaccgccgacgccgacgagcatattgggccgagcgcccgagcacctctcctgtcagcagcggcactcgccattccaagtacgaggtcgacgcgctgtggggcttgctgaaacaggtctacccccaagtgaaatcagggtcttcaagatagcttactgagatgtggggttttgcatcaaacgcttgggcagctgggctggagaagaggagttccccaagccgcacttcctcgagtgctgcttattctgacgacgaagcatcctcgtgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaaccgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatcggttgacacttcacccaccaacgcaaatcatcccaaccacggggggttccctctgctgaacacagggagggtacaagcttcgctgcgcaagtccctgtcgttcctggtccacctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcggaaaaaaaatctcaatgctgttgttggggtctgtgtaactgaattctccctagattttgttgcaagtgttgaagttatcgtc

SEQ ID NO: 9109 - DNA, 2174 bp, Zea mays
ccatctctctctctctctcctgcgccgactcatcttcaccctcgtatcacctccctgctgctgctgacgctgctgccggcaagatcaaatcgttcaaaagaccctggatttcggcgaattctagatggatcatgtgttttaggtgattggtgctttcgacctcattagtgccttttgttcaattgctggacccaaggagcagagttctgtcgacatggcatctccaagaggaaggatgtcatttccccttcgttcctttctgatgatctgcctcatggctcagctgggagcttccaatgttgtactcatggcgaacaacactaccctgtcgttcgacgacgtcgaggcaatttttactccagcagtgaaaggttcaggtgtaaatggtgtcctttatgctgtggaacctatggatgcatgcagtccattgagaacaaaagcgataggaggctctgtctcaacatttgcgttggttataagaggcggttgccatttcgatgacaaagttagaaatgctcagaatgctggattcaaggctgctgtagtatatgatactgaagacaacggtatccttgtttcaatggctggaagctcgtctggagtccacatatatgcagtgtttgtctctaaagcgtcaggggaggagctgaagaaatattcaggccaaactgacgcagagttgtggataataccaacatacgcgaactcggcttggtcaatcatggcaatttcatttatatcactgcttgttatgtctgctatcctagccgcgtgtttctttgcgaggagacaccagataagacgggacagggctcgacttccccaaactcgggagttccatggaatgaacagccggttagttaaagcaatgccaagtcttattttcacgaaagtgcaagaagacgactgcacatcagcaacatgcgccatttgcttggaagactacagtgctggagaaaagataagggttctaccttgtcgacacaagttccacgcagcctgtgtggacctatggctcacctcctggagaacattctgccctgtatgcaagcgggacgcgaatgctggaacaccagagccccctgtatcagagtcgacgcctttgctctcatcatccgccattcgcttaccagaaccaaccgcttcggtttccttctggtctacagtggcagcagcagcagcagcgtctccccccaggccaatcagccggcatccgtcgccatcacggtccatatcccgcaagcactccgtttcaggttccagcatccctggcacccctatccccaggtttcacgcaagctcatcatctcctacctgcacaagtggaagcagtttggacctcgcaaacatgccgtcgtctccatggcctcgcgcttcgcaccttgcatctgctcactcttcgtgcggtggccgcctgtccccgccgatccacatcaggaatacctctgcagcgcacgtctcgcgctctgcctatggatctcccagccgttacgtaggctcgtcgcacatgtcccgtggatctccgagttgctactaccttggatcttcttcagggcagcagcatccttacctgaggcactgcaccttgtcaggcacgagcctgttcaccatggtgccccaatcaccgcaacagaaccagctgcagcacggtggagactcggaaaaagatctgtcagctgctgcaccattccgtcagctctactacctgcagcattgtccagattctggcacgtcgtctcagtcgcttccagggtgctgattcttcattcttgctgcaaaattcaccattttaaaaaacattgatggtggctccagtaaagcttccggccgtgaggaatcttacatggcaccgaattgacatgtggatttgagctcctcagttcaccatgatgatgagagaaaaaaggtgcgacagaattgcttgtaagaagagagaattgcaccccccagaatgtgtggcttcatcttgaagaagcaaatgcccatgtcgggcttcaccagcgtttagcgtgtactgatacagctctgtagtaattctagttgctgtttgtctatcgaggtttgagccggtagcattccttcctctcttttttgttttcctaattttgaattagttatatgacagacaaggttttcaagaaaagaaataacaagttttacccctgcatttttat

SEQ ID NO: 9110 - DNA, 997 bp, Zea mays
gaggccggccggggccttgcattttcatcccctcccatctcccgttcgaattcgcgtcgggccgccacatcccagttccacctccctcctcgggccgccgtatcctagctgcctctcttgcttcttcagcaacggcgcgctagctactagtaagagtataagaaagaaagtgaatcaaggaaagagagtgagggatagagagaaactgcaaaaaaaaaaaaaacacgtagagaaggaacgacggcccagcccaggaaacacgatacggtccagagtcgagaggaagagaaaaaccacgtccccctcggccgcagaagcgaaacagcctctggccgctgcccgaccccgacgcctgctgcccaggtcttcgccggcgacgagcactccaccagacgagaggggattccaagatgccgagggcaccagcggcgcgaagctcctgatccagtccctcggcaaggcgtacgctgccacaccaacaaatctcaagattattgacctctacgtgggttttgcggttgccactgcccttattcaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaacctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgcccagcgctgagaatgtgacctagcatgttctttatttgaagaagatataattcatttttcac

SEQ ID NO: 9111 - DNA, 1124 bp, Zea mays
ccgggtccgcagaatccgagtccaatagctctcctccccagggctttcaacttctccaaaccccatctcgccgccgaggccgagcgagcagagcagaacaccacgtcggcggcttttccctgtctctccgctggatactacacccgccgccgcagcgccgatcctgtccgagtcaagcggagcgggggatcggattggttgcttccttccctccatctcatgttggtgcatcaacaaaatcttgaggagcaggagccattgtcttcaatttttgatggatcatctccagcctctgcaattgttgcagtagacacaaatctggatacttccacacctgacacatatcgagcgccgcctgcacccttgccttatgatgttattttggcagtcccaaataaccctggttttggaaactctgtaggtttggagaagccagacactaagagcaaaactgatgaccaacaagagtccataaatgatcaggagtctttagaggtggatgagtcatgtaagaaaagtgtcactgaagataaggctgatgaggaggatgtttgccctatctgccttgaagaatatgatgaagaaaatccccgttctataactaaatgcgagcatcatttccatctttgctgcattctcgaatggatggagcgaaaagatacttgcccagtttgtgaccagattactttggtggatgagatgttcgaataggtttggtaaccttggtggatcatcactcgaagctgttcgttactgagaaagtgcagcaactaatttacttttgatattgatccattccgggtggctcgcatggtaatgaattgagggggcaaaaattgaaaggatgaatgtcatgaaatgtatttacaacgcctcctttgtcatgcgttgtgtcatgctatatatatgccggcttgcgggttcattcagttcaaagtccaggactatccttttgcttttctgaattcagagtttcagacatctgctggttcttccaggttccggtcagctgtgtatatcatatattaggtggttgcaggtaaaaatggtctagagggtgggggttgctttgtacaatccacatggtatttaagcttcatgtatataatcttttctgtttctag

SEQ ID NO: 9112 - DNA, 981 bp, Zea mays
tcgaggccggccgggcaccatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcccgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaacataccaagtcttttatcaggctactcgttttctgg

SEQ ID NO: 9113 - DNA, 609 bp, Zea mays
atcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcctcttattatcttttt

SEQ ID NO: 9114 - DNA, 598 bp, Zea mays
atcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcctccc

SEQ ID NO: 9115 - DNA, 1132 bp, Zea mays
ccgggaaccacaagaagccacctcaggctcacgccgcggttccacacgggcaaatcccgccgcttcctccccacgcaccccttcccatccttcccgaagcacgaggcgagccgggccgccggatatggcgccggcggcgccgtacggcggggccgagtcgcagcggcaggcggacctactcaagcaggagggcaacgcctttttcaggaaggaacgcctcagcgccgccatcgacgcctacaccggggccataactctttgcccaaatgttgcagtatattggaccaaccgagcactttgctataggaagcggaatgagtggactagagttgaggaagattgcggaacagctatccagcttgacagccagtctgttaaggcacattacatgctcgggttatctcttgtcaacagccaaagattatcagaaggaataaaatcactggagaagtccttggagcttggaaggggtgcacatcctgcaagctacatggttgaagagatatggcaggagctttctaaagcaaaatacatcgaatgggagagcttatcaagagaccgaacttgtcaactgcaaaagctgaaggtagcatgtaaagaggccctaacgagttacaacagccttgataacccagccgcaggtgcgccagtagaacagctaaatgagctcgaggaagttttcaagaaggctgcaaagactgatactccagcagaagtacctgaccatctctgttgcaaaatcacacttgatatcttcagagacccggtgatcaccccgagcgggattacctacgagagggccgtacttctcgaccaccttcaaacggtggggaggtttgaccccgtgacccgtgaggctcttgaaccgcaccagctggttcctaatcttgccatcaaggaagctgtgcatgcgtttttgagtgagcatggttgggcttacaagattagatgatcgctttggaatacaggttttggatactgtcggatgtgacggtgggattttttgttcactgttgtgggggcagattttaatctgggatggctgcgtacagattcaccttctccagttgtgtacatatgagatgctcgttatgatagtaatatatgagatgctcgttaatctgggaaaaag

SEQ ID NO: 9116 - DNA, 608 bp, Zea mays
atcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcctcttattatctttt

SEQ ID NO: 9117 - DNA, 1007 bp, Zea mays
ccgggaaaaaaacttctaacatattgatatgttccgtatatatccacccgaccacccaccccgccgcaatccccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgccgccgcagccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagaggtttagtcccatttgcattataaccaattcaatccttgtggatgatttgtgtgattccatcgtgaatctcatggtaaaatattttcattgtgatactgcctattcgcagtag

SEQ ID NO: 9118 - DNA, 831 bp, Zea mays
ctcgaggccggccgggacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagcttgaagatattgttccttcatcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttacctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttgaattgcg

SEQ ID NO: 9119 - DNA, 566 bp, Zea mays
tcctccgacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcaaccccctggcttctgagcccggcaccatccgtggcgactttgctgtcgacattggcaggaatgtcattcatggaagtgacagcattgagagtgctaataaggagattgtcctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttc

SEQ ID NO: 9120 - DNA, 831 bp, Zea mays
ccgggagcttatcacttatcatccccatccgcacctctctccatctccctgctcctccgcctccttcttgatccagccaagccagggatcgccatcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccacatgtgaaccgtactgagtaccagctgattgatatatcagaggatggatttgtgagccttcttacttcagatggcaacactaaggatgatcttagactcccaactgatgaaactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtagttgcaccgtgtctgcattatctgtggttacattctggaccctgtattttctatgcttttatgccccctactgtttagtattaattatcaataaatttgtttgggacggttgaattgcatgcc

SEQ ID NO: 9121 - DNA, 1186 bp, Zea mays
ccgggaaaaaaaaaaaaaaaaaactcgtcgcctctccaatccctctcgtcctctcgctttctctctccatctcgtttcccccgcctgcgcagccagcgcaaaccctagccaacaagcgccgttctgcgaggctctcggcagcggataacttaacctgtcgcgcaaggatcgggggagagaaaccagcggcaacttacgtggatcggggttgtttggtgctgctgcggcggcgcagggatggaccggaagcgcatcaaggacgcgctcgagaagcacctggagaggtcgtcgccgtttacttccaggggcgtcgtgtccaaggagagggagcgcctcgctgccgggaagctgccgtcatcgcttggcaaggcggaggtgtctgatggtgaggaatttgaaactgacagtgaagattctgatgtgagtggttccgagggagaggacacgtcctggatttcatggttctgtacattgcgaggcaatgaattcttttgtgagatcgatgatgactatatacaggatgattttaacctgtgtggtctgagtaatcaggtgccatattatgattatgcacttgatctcatcttagacattgagtcttctaatgatgacgggtttaccgaggagcaaaatgaattaatcgagtcatctgcagagatgctgtacggtttaattcatgcacgatacattttaaccagcaagggtctagctgcaatgttggagaagttcaagaactacgactttggtagatgccccagggtgtactgctgtggccagccctgccttccagcagggcaatcagatgttcctagatcgagcactgtgaagatatattgtccgaaatgcgaagaacttaactatccaagatccaagtaccaaggcaacatcgatggatcatactttgggacgacattccctcatcttttcctgatgacttactcgcacttgaagccgcagaagccgtcacagcaatacactccaagggttttcggcttcaaacttcacaagccgtcatgacagagttgtagcttccgccagaagcacccctgtcacctaggttttagggagagcatcgtggccttcaaatactgttgtattattgatgtacgaattcgcgagcctgggcctcgctgtaaactattgtgaaattgtatctgttttccgatattattactgttgtgtaacc

SEQ ID NO: 9122 - DNA, 1213 bp, Zea mays
ccgggaaaaaaaaaaaagcctctcgcatttgccccgctgcccacgcccgcagcgcctcgcctcggctgctctacctctatcccgcgacccgcgagatcggaatcgcggcgccccgtcgccctcctccaaaatggcgccgtctctgctcggggggttcaccaagtcgttggccatgacggtgctctccgagatcggggacaagaccttcttcgccgccgctattctggctatgcgccatcccaggaaactcgtattggcaggctgtttaactgcactaatagtcatgacagctctatcggcttctctaggttgggttgcaccaaatctgatttcacgtaaatggactcatcatttgaccactctattgttctttctatttggcatttggtcattgtgggaaggcttcaaggaagatggagattcggaagaattggctgaagttgaagcagagctggatgctgcctttaagagtaataaaggtgaatctaaaaataaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttgaactgtcaagcgaagtgctcttcctgctcttcggtatcatgtccttactctctggaccagaaggagaattgtaatccctgcttgagcctttttcagctagctgattaacatggctttctcttcttagacctatcttatttcagtacatgaatgatggcaacgaaagccatccatccatggcgaacaggatgttgatttaacagtttagccgacacgctgtaaacatttcagtcgcccttcaaaaattactacatgttacagaagtctgtagcgattgtattctgttgtgcccagcacgtgaaagtcaacctttagcaatagctgcctacaatatgatgtaagattcttgtcactgaaattttgttatcgcaattacatgcgttaacaaagctttgttcgtgaaccaagtattcaggcaattaatatggggcttatagcaggcctttgtcttaaaaaag

SEQ ID NO: 9123 - DNA, 595 bp, Zea mays
ctcgaggccggccgggatcacaattcactccactcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtctcc

SEQ ID NO: 9124 - DNA, 832 bp, Zea mays
ccgggatagaagccggccgggatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagcttgaagatattgttccttcatcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttacctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggtgg

SEQ ID NO: 9125 - DNA, 819 bp, Zea mays
ccggatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttggaatggttgaattg

SEQ ID NO: 9126 - DNA, 693 bp, Zea mays
ctcgaggccggccgggaaaaaaaaaaaaaaaaaaatccaatccatcagtacccaatctcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggccgcaccctctacggcttcggaggctaggctaggcgcctcttcgtagtcggggactggttaggggacatgtctctgtgtgatgctttctgaggtagtattgctgcaatagctgtgtaatccatcgcttctgcaatgaagcgctttgaagcatgctacgtatgttgtgtctgtgggtgattgtatttctggtagtaacagtgattcttcctgaattttggataatacaagctcattcgcagtagtttctgatgtaatcatgtcttatcgtttgagagatgaattgcttttggcagcc

SEQ ID NO: 9127 - DNA, 1179 bp, Zea mays
ctcgaggccggccgggaacgggaggcatcctcgcaggtcgccaaaattcccacgcccggcggttctacggtcgagccaagccccctcaactgctgaacggagagttcgacctagcacgcccggccgccgccgcagcccgcaatggcgtcccttttcaaggaccccagcaagctctcggcgtacagggaccgccggttcaaggggacgcaggaggagtgtgaggcggcgctgcttgcgtcgacaacgctgtacatcggtaatatgtccttctacaccacggaggagcaggcctacgagctcttctcccgcgccggcgagatcaagaagatcatcatggggctcgacaagaactccaagaccccatgcggtttctgctttgtactgtactactctagggaggatgctgaagatgctgtcaaatacattagtggaacgatgcttgacgatcgtccaatccgtgttgatttcgattggggctttgaagaaggcagacagtggggccgtggacgaagtggtggacaagtcagagatgagtaccgtacagattatgatcctggaagaggtggttacggtaagatggttctgagggaactagaagcacagagagaattagttgactatggtggatcttttcaaccgaatgcaccacctccctatgagagaagtgagcggaagagaggacacggagattctcataggaacgacagaggagattaccagcagaaacgctaccggaacgatgaccggtcagcaccagaggagtccaagagagcaccggactctgatccagcggagaagaatcctagattccgtgagaaaggtgactctgacgaagaagaggatgactacgacggcaaacgtcgtcgctaaagctgtggaacagcctttgctactacatgcagctgttctggtgtccagtcgttgcagaagagtccacagctagcagcagtatgccagtatccgaatctcgccctgttgtacaacagatttaattcttcggtcggccattcctccttttctagtgctcctatcatctgttaatctgaatgtgcgcggtgttacatgcgctccaagtggggcactgttctcacagatacaatgagccttatctgtacgtttgctgctgatgaagcttgagaccagtgcatatattaattctaacagattgttaccgaacat

SEQ ID NO: 9128 - DNA, 814 bp, Zea mays
ccgggatcgcttatcgtctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttgg

SEQ ID NO: 9129 - DNA, 756 bp, Zea mays
tcgaggccggccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacatcc

SEQ ID NO: 9130 - DNA, 610 bp, Zea mays
ccgggatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtatcgaataatgagttgacatgccatcgcgtgtgactcattattaacaataaaacaagtttcctcttattatcg

SEQ ID NO: 9131 - DNA, 810 bp, Zea mays
ccgggcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttgg

SEQ ID NO: 9132 - DNA, 791 bp, Zea mays
ccgggaaaacgatgaagaaaagctccgtgacgcatgggtccgtcacgttgtcaccttctcaggtgattcgagcacctctgagcttatcacaattcactccactcatcttttcgcgtttagaacctctaaaatttcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtagggacttcatttgcactgtgctgtagcatgctcgtgtctagatctgtggatgggatgtgtcctgctctagtttcgtccttgtgtcttattgtatgttcgtcttcatcgagaagatcttcagcaatcagagctcgttgtgtact

SEQ ID NO: 9133 - DNA, 1501 bp, Zea mays
ccgggtaaggaatggagccgatcaataactaaggtatgcatgatctagtggttagctccaattttctagagcaggagggtgtgagttctagtgcttgctctgcactattttacttcacacccagcgcactcgagctcgagccctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacgagg

SEQ ID NO: 9134 - DNA, 917 bp, Zea mays
ccgggatcagtcacttcaacggttcgaacttccatatctctcctctgctctcactctcctcccacccactccagatcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgctggtacaaacttatatgaattgaaactagatctgaatgacaaagtaaacgttgaggctagcaaaataagtgtgggtgtcaggtccatattctgtattgtagaaaaagctgaggccaaatggtggaagaaacttgttcgagatgatcaaagggcacctcactttgtgaaagttgattgggacaaatgggttgacgaagatgatgatggtgctgatgtcaacttggatgggatggacttctcgaattttggcggtatgggtggtatgggtggcatgggtgatatggctggcttgggtggtcttggtggaatgggtggtatgggaatggatgattttgaggatgatagtgatgaagaagaagtatcgaaacctcaagctgccggacatgctgctgaggccgagaagactgagtcggcggaagccaagactgagtcggctcagagcagttgaagatgcttccgacatgatctaaactagttgtatcgtcaagttaattctgctgaatcggtggacaaacttctacgttgtggcactggccgatcccagtgacttgccctaaaatttacgttctgtctttacatgggcatcctagtgttgtgctcatcacattattgatattgtttctgtgatgcttcctttggtcaac

SEQ ID NO: 9135 - DNA, 690 bp, Zea mays
ccggccgggatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcctcttattatctttttatatctctccctatccatttttgtaaagcccattatcctttactccctaagtcccaaaatattttagacctg

SEQ ID NO: 9136 - DNA, 676 bp, Zea mays
tcgaggccggccggggtgtaatcagttagtggtattaataaacgttcctgctacagtcgaattttaaaaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactgcgacgccgtctcgcagattatgctgcaacagcagttaccattcatgttcaacccaatggccatgacgattccacccatgttcttacagcaaccctttgttggtgctgcattctagatagaaatatttgtgttgtaccgaataatgagttgacatgccatcgcgtgtgactcattattaacaataaaacaagtttcctcttattatc

SEQ ID NO: 9137 - DNA, 810 bp, Zea mays
ccgggcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaatgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttggat

SEQ ID NO: 9138 - DNA, 1721 bp, Zea mays
ctcgaggccggccggtttctaagttaaatcctaaggaaaaaaatggtgcttcttggtgctgcaaaaaaaaaaaaaaaaaatgttccactccaggtggaggctgcagccccggtttcgcaagccgcgccgtggtttgcttgcccacaggcggccaaaccgcaccctccttcccgctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatagagagtgttggagagggtgtgactgacgtagctccgggcgaccatgtccttcctgtgttcactggggagtgcaaggagtgtgcccactgcaagtcggcagagagcaacatgtgtgatctgctcaggatcaacaccgaccgcggtgtgatgattgccgatggcaagtcgcggttttcaatcaatgggaagcctatctaccactttgttgggacttccaccttcagcgagtacaccgtcatgcatgtgggttgtgttgcaaagatcaaccctcaggctccccttgataaagtttgcgtccttagctgtggtatttctaccggtcttggtgcatcaattaatgttgcaaaacctccgaagggttcgacagtggctgttttcggtttaggagccgttggtcttgccgctgcagaaggtgcaaggattgctggagcgtcaaggatcattggtgtcgacctgaaccccagcagattcgaagaagctaggaagttcggttgcactgaatttgtgaacccaaaagaccacaacaagccagtgcaggaggtacttgctgagatgaccaacggaggggtcgaccgcagtgtggaatgcactggcaacattaatgctatgatccaagctttcgaatgtgttcatgatggctggggtgttgctgtgctggtgggtgtgccacataaggacgctgagttcaagacccacccgatgaacttcctgaacgaaaggaccctgaaggggaccttctttggcaactacaagccacgcactgatctgccaaatgtggtggagctgtacatgaaaaaggagctggaggtggagaagttcatcacgcacagcgtcccgttcgccgagatcaacaaggcgttcgacctgatggccaagggggagggcatccgctgcatcatccgcatggagaactagatttcgctgtctagtttgtgatctggcctgggcttggggttaataaaagaggcaatgctagcctgccctttcgatgaggaggtacatacacgctggcgatggaccgcgcttgtgtgtcgcgttcagtttggcttttgccaagcagtagggtagcttcccgtgtcggtaattatatggtatgaaccatcaccttttggctctacatggtatgaacgtaagatacaaattccaactacctctagctcgcttgtgtggtatctgtatcagtattcatgtgtttgtttgcttatgtgtttgtttgcttgt

SEQ ID NO: 9139 - DNA, 844 bp, Zea mays
ccggggctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatcaggctggcacataataaagaagtagatcatgcacccactagtgatcacttcgtctagtgtccctccgttcgtcgtcgtcgtcgtcgtgtacctcgtacgtgacatgctgtagcacgtactacgctagcagagcagcacctcaatgtccttgggtttgctttgctggctctctgttttcgtcttgtgttgcttttaatctggcacaggtttctaaattataataatgaatacttttttgtct

SEQ ID NO: 9140 - DNA, 813 bp, Zea mays
ccgggacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctatggttacattctggaccctgtattttctatggttttatgccccctactgtttagtattaattatcaataaatttgtttgggacggtcg

SEQ ID NO: 9141 - DNA, 768 bp, Zea mays
ccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgtc

SEQ ID NO: 9142 - DNA, 822 bp, Zea mays
ccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttggaatggttg

SEQ ID NO: 9143 - DNA, 859 bp, Zea mays
tcgaggccggccggggctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccagt

SEQ ID NO: 9144 - DNA, 814 bp, Zea mays
ccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttag

SEQ ID NO: 9145 - DNA, 839 bp, Zea mays
ccggatcccatccatcacagctagctagcgtacagacgaataatctcttcattcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtac

SEQ ID NO: 9146 - DNA, 859 bp, Zea mays
taaatgagactaaaatggagggaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgctt

SEQ ID NO: 9147 - DNA, 841 bp, Zea mays
ccgggatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtcc

SEQ ID NO: 9148 - DNA, 834 bp, Zea mays
cctcgaggccggccggggagcttatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttttatgccccctactgtttagtattaattatcaataaatttgtttgggacggttg

SEQ ID NO: 9149 - DNA, 840 bp, Zea mays
ccgggcatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaagtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtccgcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagttgtcgtcgtagcagagatgtcctagctacgtgtgtgtcatcaggctggcacataataaagaagtagatcatgcacccactagtgatcacttcgtctagtgtccctccgttcgtcgtcgtcgtcgtcgtgtacctcgtacgtgacatgctgtagcacgtactacgctagcagagcagcacctcaatgtccttgggtttgctttgctggctctctgttttcgtcttgtgttgcttttaatctggcacaggtttctaaattataataatgaatacttttttgtct

SEQ ID NO: 9150 - DNA, 844 bp, Zea mays
ccgggctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatcaggctggcacataataaagaagtagaccatgcacccactagtgatcacttcgtctagtgtccctccgttcgtcgtcgtcgtcgtcgtgtacctcgtacgtgacatgctgtagcacgtactacgctagcagagcagcacctcaatgtccttgggtttgctttgctggctctctgttttcgtcttgtgttgcttttaatctggcacaggtttctaaattataataatgaatacttttttgtcct

SEQ ID NO: 9151 - DNA, 998 bp, Zea mays
ccgggcccgtctctcgttctctccttcctatcggctccacacctccacgcaactggaagcttcgctgcaatctgccctactcctcttccgccgcctccaacaccgcagacgcagctgccgcgggcgggagcttggacgtgctactctgctctcatctcgtttccgcgcaggaattgttctcaatggcccgcgtgtatgttggcaacttggattcacgggtgacttctggggaactcgaagatgagttccgtgtgtttggagttctgcgaagtgtttggattgcacgtaaaccacctggctttgcatttattgattttgacgacaggagggatgcggaggatgctattcgtgatctagatggtaagaatggatggagagttgaactatctcgtaattccagtggtcgtggtggtcgtgatcggtatggtggatctgagtcgaagtgctatgaatgtggtgagactgggcactttgcacgtgaatgtcgtctgcgcattggctctggaggtctaggcagtggaagacgtctcagtcgcagccgcagtcgcagtcgcagtcgcagcaggagcaggagcagaagccgcagccctagataccgcaggagtccaagctatagtagaaggagctatagccctcgttatcgctctccaaggcgccgtagtccttcgccagctcgcgcgcgcagctatagcaggtcaccatagtacaactgcaacgatgctgttatgcacaggtaatggtggcaggtactggtgtagcaggagctaggcctgaagcccgtgcctgatacttcttggtgtgagaacttagtccttggtttggctgtcaggaacaaatttggaactgtcgtcaactgcatgacttcagttcaggtttaaaaccttatctagcttaattgtgattgccttgattatgccattatagaacttaatatttggatgtattatgcgactaagacatattacctttcttctctgttgaaaaggcatgttctgctt

SEQ ID NO: 9152 - DNA, 816 bp, Zea mays
ctcgaggccggccagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatcaggctggcacataataaagaagtagatcatgcacccactagtgatcacttcgtctagtgtccctccgttcgtcgtcgtcgtcgtcgtgtacctcgtacgtgacatgctgtagcacgtactacgctagcagagcagcacctcaatgtccttgggtttgctttgctggctctctgttttcgtcttgtgttgcttttaatctggcacaggtttctaaattataataatgaatacttttttgtcc

SEQ ID NO: 9153 - DNA, 1187 bp, Zea mays
ccctcgaggccggccgggaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcaaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagaaccatcttgtgccgtcttccactgcccccgagtccaaggtcttctatctcaagatgaagggtgattactacagataccttgctgagttcaagactggagctgagagaaaggacgccgctgagaacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagcccttttaaactgttgtcacttgcattttaccttttccatcgctgtttattgtgagtggtcct

SEQ ID NO: 9154 - DNA, 554 bp, Zea mays
ccggggccgacttctgattctaccaccacccgcctcctctcgagttcgatctgtttgctcccccagacatgtcgggccgcggcaagggaggcaagggcctgggtaagggcggcgcgaaacgacaccgcaaggtgctccgcgacaacatccagggcatcacgaagccggccatccggaggctggcgcgcaggggcggcgtgaagcgcatctccgggctcatctacgaggagacccgcggcgtgctcaagatctttctcgagaacgtcatccgcgacgccgtcacctacacggagcacgcacggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgtgtggg

SEQ ID NO: 9155 - DNA, 837 bp, Zea mays
ctcgaggccggccgggatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccacggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataacg

SEQ ID NO: 9156 - DNA, 816 bp, Zea mays
ccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttttacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagtgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgt

SEQ ID NO: 9157 - DNA, 822 bp, Zea mays
ccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagaccggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttggaatggttg

SEQ ID NO: 9158 - DNA, 819 bp, Zea mays
ccgggagcttatcccttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgaactggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttgc

SEQ ID NO: 9159 - DNA, 812 bp, Zea mays
ggccgggatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacgg

SEQ ID NO: 9160 - DNA, 2102 bp, Zea mays
cggccgggacacagacacagcctcccaccacaaaccctcctccagtgctcttttcttctagccgccgccgcaaccgcttgctagcgctctgcgctctcatcctcgcgtccgtggaaggtcgtctcgacatggcctccgagacggagacgttcgccttccaggcggagatcaaccagctgctatcgctcatcatcaacaccttctactccaacaaggagatcttccttagggagctcatttcaaactcctccgatgccttggataagatcaggttcgagagtttgacggacaagagcaagctggatgcccagccggagctgttcatccacatcgtccctgacaaggccaacaatactctgacaatcattgacagtggcattggtatgaccaagtcagaccttgtgaacaaccttggtaccattgcacgatctggcacaaaagagttcatggaggcactggctgctggtgccgacgtgtccatgattggtcagtttggtgtcggtttctactcggcataccttgttgctgagagggttgtcgtgaccaccaagcacaacgatgatgagcagtatgtatgggagtctcaggccggtggctccttcactgtcacacgtgatacctctggggagcaacttggcaggggtacaaagatgaccctttacctcaaggatgatcagttagagtatcttgaggagcgccggctgaaggatctgatcaagaagcactcagagttcatcagctacccaatctctctctggatcgagaagaccactgagaaggaaatatctgatgatgaggacgaggaagataagaaggacgaggagggcaaggttgaggatgttgatgagaaggaagaaaaggaaaagaagaagaagaagatcaaggaggtttctcatgagtggcaattggttaacaagcagaagcctatctggatgagaaagcctgaggagattaccaaagaagagtatgctgctttctacaagagcttgaccaacgactgggaggagcatctcgccgttaagcacttctctgttgagggtcagcttgagttcaaggctgtcctgtttgtgccgaagagggccccctttgacctcttcgacaccaggaagaaactgaacaacatcaagctctatgtgcgccgtgtcttcatcatggacaactgtgaggagctgatcccagagtggctgagctttgtcaagggcattgttgactctgaggaccttcccctcaacatctcccgtgagaccctccagcagaacaagatcctcaaggtcatccggaagaacctggtgaagaagtgcattgagctgttctttgagattgctgagaacaaggaggactacaacaagttctatgaggccttctcgaagaacctgaagcttggcatccacgaggactccacgaacaggaacaagattgcggagctgctgaggtatcactccaccaagagcggagatgagctgacaagcctcaaggactatgtgactaggatgaaggagggccagaatgacatctactacatcactggcgagagcaagaaggccgtggagaactcccccttccttgagaagctgaagaagaagggctatgaagtcctgtacatggtggacgccatcgacgagtatgctattggccagctcaaggagttcgagggcaagaagctcgtctcggccaccaaggagggcctgaagctcgatgagagtgaggatgagaagaagcggaaggaggagcttaaggagaagttcgagggcctgtgcaaggtgatcaaggaggtgctgggcgacaaggtggagaaggttgtggtctctgaccgcgtggtggactccccctgctgcctggtgacgggcgagtacggctggacggccaacatggagaggatcatgaaggcacaggcgctcagggactcgagcatgtctgggtacatgtcctccaagaagaccatggagatcaacccggacaacgccatcatggaggagctgcgcaagcgcgcggaggccgacaagaacgacaagtctgtcaaggaccttgtcatgcttctgttcgagacggcgctgctcacctcggcttcagccttgacgaccccaacaccttcggcggccctc

SEQ ID NO: 9161 - DNA, 1952 bp, Zea mays
ctcgaggccggccggggtcttccccgacccgcgtttctttattatattttcccccaaattccacctccaccaacctcctctcccaccaccgcccccgccgtcgcctgctgttccatgaaggactaatccgtcggtccacttctcagctatggcgcagctcgcggtgcggtcgctgctgctgtccctgctcctggtctcgccagttgtggcttcacctggtattgtgaagctcaactcgtcgtcgaccctcttcggcatcgagttcccgccgttcaacaccgccgtcgccgcgaccggctgcgacagcaagctggttgcagccgacgaggcgggggatgagcagaagcagccggcgagctcgtccccgtcgctgcagctgcgcatgaagcaccggtccgcggaggggggcaggacacggaaagagtcgttcttagataaggccgagaaggatgccgtccgcatcgagacgatgcaccggagggcggcgcgctccggcgtggcccggatgccggcgtcttcgtctccgcggcgggcgctgtcggagcggatggttgcgacggtggagtccggcgtggcggtcgggtccggcgagtacctgatcgacgtctacgtcggcacgccaccgcggcgtttccggatgatcatggacaccggcagcgacctcaactggctgcagtgcgcgccgtgcctggactgcttcgagcagcgtggcccggtgttcgaccccgccgcgtcctcctcctaccgcaacgtcacctgcggcgaccagcgctgcggcctcgtggcgccgcccgaggcgccgagggcgtgccgccgccccgcggaggactcctgtccgtactactactggtacggggaccagtccaacactaccggcgacctggccctggagtccttcacggtcaacctcacggccccgggcgcgtcccgccgtgtggacggcgtagtgttcgggtgcgggcaccgaaaccgcggcctcttccacggcgcggcggggctgctggggctcggccggggcccgctgtcgttcgcgtcccagctccgcgccgtgtacgggcacaccttctcgtactgcctggtggagcacggcagcgacgccggcagcaaggtggtgttcggggaggactacttggtgctggcgcatccgcagctcaagtacacggcgttcgcgcccacgtcgtcgccggcggacacattctattacgtgaagctcaagggcgtgctggtgggcggcgagctgctgaacatcagctcggacacgtgggacgtgggcaaggacgggtccggcggcacgatcatcgactccggcacgacgctgagctacttcgtggagccggcgtaccaggtgatccggcaagcgttcgtcgatctcatgagcaggctgtaccctctgatcccggacttcccggtgctgaacccgtgctacaacgtctctggcgtggagcgaccggaggtgccggagctgtcgctgctgttcgccgacggtgccgtgtgggacttccccgcggagaactacttcgtccggctggacccggacggcatcatgtgcctggcggtccggggcaccccgcgcaccggcatgtccatcatcggtaacttccagcagcagaacttccacgtcgtgtacgacctgcagaacaaccggctgggcttcgcgccgcggcggtgcgccgaggtgtagtgtatagccgccggcgaggcctcctgagactgagaggacgaacaattcgaactcagtcctcgcttgattgattggattgggaggcaaattgggtgtagaaatttttggttgggaaggacggtggcacgtacgcaagctctaatacatagttttttttgttgcatttatctccaaggagagaaggttagggatattttattaaggaccgtgcaggtgggttgtaacgggaaatactgattttgttcccatgtacaatacccgtttcttcact

SEQ ID NO: 9162 - DNA, 1541 bp, Zea mays
ggtaaattacacgccaccaccgctcgacctaccagccctccttcctcatccgcctgccctgcccgtcccgtccgtccacccccttcccttctttcccctttgcttgctgctgcctgcttctcgccgtcgccgcctcaattccctcctcctcgtccgtcgcctcgtccacgcgcacctcgtcctcctctccgttcccaccacctcctcgaccgcaccgtcctcttctagctagcggagcgagctgcgaccagatcggagagccaagcacccaggagggggggccggggaacaagaagaagccgtcggaagccgggcgtggacgtgtggtggttttctgccggcggctgacaagtggtgtaggctacccgctctggccatggatccgtcgggcggcgcgttcctgccgccgctgcagcaagggagctcctccttcccgcggtcctccagcaacgcgtcgctcgccaggagcggcagcggcggcggcggcgttggcgccgggcgcgggaccaggggcaggaagatgatgcgcagggtctgccgcggcgtcatcaccttcatcttcgccatcgctgggctgttcctgggagcggtgaccggcggtctgatcgggctggcgacggagagcgggctgttccgcggcaccgggatcggcgccatcactggcgcgctcgtctccatcgaggtcgtcgactcctccatccgcctctggcaggcgcgccgatccgggatctggagcatcctctacgtgctgaacgtgatctacagcctcctgacgggcaggctggtgcgcgagaaggtcgacccggcggtgcaacgggtggtccgcagccagatgaacgcggtggactcgtcgccgttcagggagtcgccggacctgtttgaggtggaggccaccaacggcatgccgcgggcgtccatcgacaagctccccgagtcgtggatcaccgaggagtacaggcgcgacgccgtcggcgacctctccggctgctccgtctgcctccaggatttccaggtcggggagaaggtgcggagcctgccggactgctggcacgtgttccacgtgccgtgcatcgacggctggctcatcaagcacggctcctgcccgctctgcaggaggaagctgtaggcggatcgaccggacgacgccatggacgatgttcttctctgcgatcgagccgatgatgtgtgtgtgtgtgtgcccccgccgccaccaccgatagctgctgctagggtcggaggagggaggaggaagaagagactgacatctatagaacccttaatttatagagagggcttttgctttgctacttgtacgtgctctactacgtacctattgcaactttttttttgattcaccatgatcgacctccttcctcagatccatccatgcatgtaatataccctggaccggcttgtgcttcgttcgatccattccatgcatctccggactgtgatctcgatctggtgtaatatatataaaaaaactactagtatgtaccatcgcactttggacatctatacatgcatgctggttggtcagc

SEQ ID NO: 9163 - DNA, 1812 bp, Zea mays
agtctagaggcgtttgctccccaatcccttcggcccgtccgcccgcccgctcgacgtgatcccaccggcagccatggatccatacaagcaccgcccgtctagtgggagcaactccagcttctggaccaccaactccggcgcccccgtctggaacaacaactctgccctcaccgtcggacagcgaggtccaatcctccttgaggattatcatctaatcgaaaagcttgctcagttcgacagagaacgtatccctgaacgtgttgtgcatgcacggggagccagtgccaagggtttctttgaggtcactcatgatgtctctcaccttacatgtgctgattttctccgtgctcctggggtccagacacctgttattgtccgtttctctacagttgtgcatgagcgtggaagccctgagaccttgagggatccacgtggttttgctgtcaagttctacaccagagagggtaactttgacctcgtgggtaacaacatgcctgtgtttttcatacgagatgggatgaaattccctgacatggtccacgctttcaagccgaatccaaagaccaatttgcaggagaactggagaatagtagatttcttctctcaccacccagagagcctacacatgttcaccttcctctttgacgatgttggcatcccactatacctacaccttgatcaacagggatggaaagcctcaccttgtgaaattccattggaagcctacttgtggtgtgaaatgcttgctcgacaatgaagctgtgactgttggaggcacctgccacagccatgcgacgaaggatctatatgattccatcgcagctgggaattaccctgaatggaagctctacatccagactattgatcttgaccatgaggataagtttgactttgacccgctcgatgtcaccaagacctggcctgaggatatcatcccgctgcagcccgttggacggatggtcctgaacaagaacgtcgacaacttctttgcagagaatgaacagattgctttctgcccagcgattattgttcctggaattcactattctgatgataagctgctccagacgagaatcttctcctatgctgatacccagaggcaccgccttggtccaaactatctgatgcttcctgtgaatgcaccaaaatgtgcccaccacaataaccaccatgatgggttcatgaacttcatgcacagggacgaagaggtgaactacttcccttcgaggtttgatcccgcccgtcacgcggagaaggtccccattcctccccgtgttctaacaggctgtcgtgagaagtgcatcattcagaaggagaacaacttcaagcaggctggcgagagatatcgttccttcgaccctgcaaggcaagaccggttcatccagcgatgggttgacgcactgacagaccctcgcgtgacccatgaacaccgtaccatttggatctcctactggtcccagtgcgacgccgctcttggccagaagctggcttctaggctgaacctgaagccgagcatgtaagatcgacgaggaagaaagcaggcaccggtggccaaggatgcaacgcaacatggagcgtgtgatgtttacaccaatataattgaataaacaggggatgtgcgcgtcgttgtacttatgctgatgctgatggtcggtggtcgattatatatactggaacttctggtgtatgctcttctcttctggggagacgtaatgtaacgaagaagaatgtgtcattgtggcctgtggtacaaaccctgctgtgtatgggcctgtctataagaaacagcgatgagctgtgacgttatgttac

SEQ ID NO: 9164 - DNA, 1781 bp, Zea mays
ctcgaggccggccgggaatagcctctcctcgtcccccctcaagaactgtacccatcacgcgccgccatcgattgaccttgaccgacccgaccacccatcacgcttcttgttgccgccgccgctgtgctttgcggatacgcggtggctgcgctcgccggcggggaagaggggtcgcgggctgcgcgcctccagtctttcttcgcctccgtgctctcgggcctcttcggccaggccgaccaggacgaggaccaagagatggcctcgcgcaaccacaacgccgccgctccgcagcttcaccatcacaaccgagccggtgttcccgctcttggaaagaccaaggccgtgcccgcccgagctgacgctctgaaccggcgaccccctctcggcgatatcggcaacctcgtcagcgtccgcccagccacagggaacccgcaggagcaggtcaatcgccccatcactagaagtttcggcgctcaactcgtcaagaaagcgcaggcgaaggccgcaatcaagaatgccgcaatcctgcctgcgaggcatgcgccgaggcaggagaggaaggctcctgtcaagcagcaaccgccgccggaggatatcatagtactcagctccgattctgaacagagcagggcgcagtccgagagcagcgctagctccgtccgctccaggaggaaggccatcaacaccctttcttccgtgctctcggctcgctcaaaggctgcctgtggaatcgctggtaagcctagacaagtggtcgatgacatcgacaagctggacgtcaacaatgagctcgcggtggtggaatacattgagtacatctacacgttctacaagattgctcagcacgagagacggccatgtgactacatcgacgcccaactcgagatcaactctaagatgagggctatcctggctgattggataatcgaagtacaccacaagtttgaactgatgcccgaaactctctacctgaccatgtacatcatcgatcagtacctctcgctgcaaccagtcctgcgtaaggagctgcagcttgtcggcgtttcatctatgctgatcgcctgcaagtacgaggagatttgggccccagaggtgaacgacttcatcctcatatcagacagtgcatacagtagagaacagattctttcgatggagaagggaattctgaataggctggagtggaacctgactgtccctacagtgtatatgttccttgtccgttttctgaaggccgcaacattgggcggcaaagttgagaaagagatggagaatatggtgttcttcttcgctgaattggcgctgatgcaatacgatttggtgacgcgcctgccatcgctggtcgctgcttctgctgtctacgcagccagactcactctcaagagggctcccctttggaccgacaccctcaagcaccacacgggcttcagggagtcagaggcagagctcattgaatgcacgaagatgctggtgatcgcgcactcgactgcccctgagagcaagctgagggttgtatacaagaagtattccagcgagcagttcggaggggtcgcgctgcgtccacccgcagaggagatctgcaagtgaacgaaggctactttatccgtgtttgcctattgcttgctttaggggaagtggcgatggaaggcgagtctgacattcgctaggcttttttatgtttgcttgtttcagacagccgtttgtttgctaggctgttctcagagtcggttgttatctgacttgtgatggcaactataattctatctagtacaacatttttattt

SEQ ID NO: 9165 - DNA, 636 bp, Zea mays
gcgaatggggaaggtgtggatcgagaagcttatcgcttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgcccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacg

SEQ ID NO: 9166 - DNA, 1080 bp, Zea mays
ctcgaggccggccggggtgccctagtaaccctagccgcctgaggccgacgccaactctctcctgaccgcaacggggaactcgccccccgcctccgccaccgcgccggtcgccgacccactcagatgaacacgtctccgtccagatacagggcaatgatgggaggctgggggggttcggatgggtacgagggatcaaagaggacgcgaatgatgatggaatcgaatccctacttcgcagtgaacgcagggagcccactggatgtctcaaagagggccaggatgatggaaccaggtgctccctattttggggctatgggaagcagcgccagcggtgccggcggcggcttctaccagccctttaacagcaacctagctggtgcagggtctagcaccggtatccaaagcttcccatgtgtccggctgcgaggcctcccctttgattgcaacgacattgacgtctgcaagttctttgtggggctggacatagtggactgcctcctggttaacaagaacgggcgcttcaccggcgaggcttttgtagtcttcccaacagccatgcaggcagagtttgcgctgcaccgcgacaggcagaacatggggcggaggtatgtcgaggtgttcaggtgcaagaagcacgagtactactgtgcaatagccaatgaggtgaaccagggcggttatttcgagccggagtaccgccgctccccgcctcctccgaggcctaggaagccgtctgaagataagggcagcatggagtacacagaggttctgaagctccgcgggcttccctactctgccaccactgaggacatcatcaagttcttcctggagtacgagctggcagaggagaacgtgcatatcgcctaccgctccgatgggaaggccacgggtgaagccttcgttgagtttccgacagctgaagtcgcgaagacggccatgtgcaaggataagatgaccattgggacgaggtacgtggagctgttcccgtcgaccccagaggaggccagcagggcgaaatcccgaggcaggcattgaagaaacgtgttccagtgatcttctgtatgcatgcatgcggccctc

SEQ ID NO: 9167 - DNA, 860 bp, Zea mays
ctcgaggccggccgggatacaccccacccatggcaccacccttgctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaatt

SEQ ID NO: 9168 - DNA, 808 bp, Zea mays
gcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 9169 - DNA, 755 bp, Zea mays
ccggatcactcatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttg

SEQ ID NO: 9170 - DNA, 1224 bp, Zea mays
gggacggcctgtcccctcacctcctccccctatctctccaccgccgcagctagctgtgacgtcatgcactcgccggcgccaccgccaccgccaccgccaccgcatactatctacaattagccagccgtagccttacttatcctgtgtcaagcaaacctctcgcaaggaacaaggaaggaagctgcttgttttatagccgctgtcggcggcggcggctgaagcgacgtgcctgggctaggatttaggttgagatcaagagagggagaaggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgctctcatcatcttctccaccaagggcaagctctacgagtactctaccgattcatgcatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaaggagaagtcactgcaggaagagaacaaggttctgcagaaggagctcgcggagaagcagaaagaccagcggcagcaagtgcaacgggaccaaactcaacagcagaccagttcgtcttccacgtccttcatgttaagggaagctgccccaacaacaaatgtcagcatcttccctgtggcagcaggcgggagggtggtggaaggggcagcagcgcagccgcaggctcgcgttggactgccaccatggatgcttagccacctgagctgctgaaggtttgctctcaccgtcgcggtgtgctagcccaaaatccagcaagtcttccccggaccccggactggccccgcttctccgcctggtgcagtatcgtagtgatcgcgagaagcagcagcagcggtttgccgtatttttttaccaccgtgtataagtagcatatctgcaatgtgtatatattgttcaccgttcctgctggggcggccctc

SEQ ID NO: 9171 - DNA, 857 bp, Zea mays
ctcgaggccggccggggctccatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgttgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtcc

SEQ ID NO: 9172 - DNA, 939 bp, Zea mays
ggccggccgggaatccccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgccgccgcagccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagaggtttagtcccatttgcattataaccaattcaatccttgtggatgatttgtgtgattccatcgtgaatctcatggtaaaatattttcattgtgatactgcc

SEQ ID NO: 9173 - DNA, 771 bp, Zea mays
atcacaattcactccactcatcttttctcgtttagaacctctaaaatttcccccactcgccagtcgcagcagcacctgtagcagccatggacgccagcggagccggtagcaaggggaagaagggggcggccgggcgcaaggcaggcggccccaggaagaagtcggtgacacggtccgtcaaggccgggctgcagttccccgtcggccggatcgggcgctacctcaagaagggccggtacgcgcagcgcgtgggcactggcgcccccgtctacctcgccgccgttctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggtggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcatgctctagtatcgtccttgtgtcttattgtatgttcgtcttcatcgagaagatcttcagcagtcagagctcgttgtgtactaatgttcccccatgttctgtttctcgttctgattctgcaattcgtcatattgttgaattt

SEQ ID NO: 9174 - DNA, 2092 bp, Zea mays
ctcgaggccggccggaaacccgggtctgggtggcgtcgcctttcatcattcccccctcgtgctctctctcgaaccttcttccaaagcacccgaaccctagtgatctcggaaccctagccgcgcgcggatctcggcttttccccttcctccacgccagccatggacggggacttcgagatgcctcccgccggcgccgatgacatgatgggcgacgacgagatgggcgacttcggcggcgacgagggcccggtgatgaaggtgggcgaggagaaggaggtcggcaaggaggggctcaagaagaagctgctcaaggagggcgagggctgggagactcccgaggtcggcgacgaggttgaagtgcattacacgggcacgctccttgatgggacaaaattcgactcaagccgtgatcgtggagaacccttcaagttcaagcttggacaaggtcaagtgataaagggttgggatcaaggaatcaagaccatgaagaaaggagaaaatgctatttttaccattcctccagagctggcttatggagcatctggttcacctccaactatcccacccaatgcaaccctgcagtttgatgttgagctgctttcatggaccagtgtcaaagacatttgcaaagatggcggcatattcaagaagatccttaaagagggagagaaatgggagaacccaaaggatcctgatgaagtacttgtgaaatacgaggcctgtctggaagatggtactgttgtatccaagtctgagggggttgagtttactgtgaaagatggctacttttgtcctgccctggctaaagctgtcaaaaccatgaaaaaggcagagaaggtgctccttacagtaaagccacaatatggatttggtgagaagggtagaccagcagctggagaggaaggtgctgtgccgccaaatgcttcgctgctcattgaccttgagttgatttcatggaagactgtcacagaaattggggatgataagaaaatccttaagaaggttctcaaggagggagaaggttatgagcgtcccaatgagggtgctgttgttgaagtcaaaattatcggaaagcttctggatggcgcggtgtttacaaagaaggggcatgacgaagagctatttaaattcaagaccgatgaagaggaagttattgccggtcttgatcgtgctgtgttgaacatgaagaagggcgaggttgctcttgtcacaattcctcctgaatatgcatttggttcaactgagtcaaagcaggatcttgctgttgttccacctaacagcacagtaatatatgaagttgagcttatttcatttgtgaaggacaaggagtcgtgggacttgaacaatgaagagaagattgaggctgctggtaagaagaaagaggaagggaatgcattgttcaaatcaggcaaatatactagagcttccaagcgatacgagaaggctgccaagtacattgagtacgacacttcgttcagtgaagatgagaagaagcaatccaagcaactgaagatcagctgcaacctaaacaatgctgcctgcaaactgaagttgaaggattacaaggaagctgcgaagctttgcaccaaggttctggaacttgacagccgaaatgtcaaagctctctacaggagggtgcaagcttacattcaacttgctgacctagagctagcagaggccgatatcaaaaaggcactggaaatcgatcctgacaacagggatgtcaagttggaatataagatcctgaaggagaagatcaaggagtacaacaagaaggacgccaaattctacagcaacatgttcgccaagatgacaaagtaactgtcactgccctaagtcagcgtagcttttggggtggaggatgttgtggtgaagcaaagggattaaaaacaccgatttctgctgccaaaggacttcgcccgttgcttaacttctcgcttttcgcatactttgtagtcaactagtgtgcacggatgcttggatatgtgaaactgaggaacatgtacttcgaggattattattggttctgaatttttatgttttctggttcttgttaggaccattgaatgttctctatataattttcggacgc

SEQ ID NO: 9175 - DNA, 843 bp, Zea mays
gttcggccgggatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattaccaataagttggtttggaatggttgaattgc

SEQ ID NO: 9176 - DNA, 842 bp, Zea mays
atcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatggggggggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctactttctagtattaattatcaataagttggtttggaatggttgaattgcatccaatgcatgaagtttctttggtt

SEQ ID NO: 9177 - DNA, 829 bp, Zea mays
ggccggccggggagcttatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccacatgtgaaccgtactgagtaccagctgattgatatatcagaggatggatttgtgagccttcttacttcagatggcaacactaaggatgatcttagactcccaactgatgaaactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtagttgcaccgtgtctgcattatctgtggttacattctggaccctgtattttctatgcttttatgccccctactgtttagtattaattatcaataaatttgtttgggacggttg

SEQ ID NO: 9178 - DNA, 1181 bp, Zea mays
acagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccgtgtgctcaagatccgtggtttggacaaggagtatgagggcaatgttgaggccactggtgaggacttctctgttgagccagctgatgagaggaggcctttccgtgctctcttggatgttggccttatcaggactacaacagggaaccgtgtctttggtgccctcaagggagctttggatgggggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagagccacttcagtgcgtacattaagaagggagttgaggctgaggaaattgaagccctgtacaagaaggttcatgctgccatccgtgcagatccttccgttgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtgaagtttagtgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctttacattgaaatgctgtcgtttggacatgttttttctgagttctacacctgcttgtcttgcttatgtgacggtggagtattgtgcctttaatatcaaccc

SEQ ID NO: 9179 - DNA, 1803 bp, Zea mays
cctcgaggccggccgggatttggtctcatatcttcttctcgtccgtctcgcttctctctctcctgaggcgcagcggtggggtggggtagggccgtagggggagcggcattgcgagctcacaccacctgcggcgcggcgatcccgggccaccgactgtcgggctatgtgatgatccgggccgtgatctcgacggctattcgcggctgaacgggcggcggcgatgaacggagcgagcgccggcgtcggcggggaggcgccgctggtgtacaaggcatggaaggggaacaatgtgtttctactgaaggggaggttcatatttggccctgatgcaagatccctgtttatcaccatgttccttattgtcgcgccggtatcaattttctgcgcgttcgttgccaaggaattgatggataagttctcttatggtctgggattgccggttatgattgcagcagttctattcacagcatatgatctgagtcttctgcttctaacttctgggagagatccagggatcatacctcgcaatgcacatcctccagaacccgaagggtttgatggcaatgcagaggttggggctaaccagactccacccgtgcgtttgccccgagtgaaggatgttgttgtcaacggaatcactgtgaagacaaaatactgtgacacttgcatgttgtacaggcctcctcgttgctcccattgctctatctgcaacaactgcgtggaacgttttgaccatcactgcccctgggttggacaatgcataggacttaggaattacaggttcttctatatgtttgtattctcaacaactttgctctgcctgtatgtctttgggttctgctgggtgttcattattaagatcagaaatgccgagcagataacaatttggaaggcaatgacaaagacccctgcatctattgccttaatcatctacacattcattgcagtttggtttgttggtggcctctctgtgttccatctgtatctcatgagcacaaatcagacaacatatgagaacttcaggtatcgctatgatcagcgagacaacccatacaacaagggagtcatggaaaacatcaaagagatcttctttacaacaatccctccttccaagaacaacttctgtggtagggtcgaacaggagcatggtctgaggccccgtccaacgaatggtttcatgagtccaaacatggggagagctgttggcgacattgagatgggtagaaaaccagtggcttgggatgagcctaggatggcggctgaaattggtgatttaggagcaggtctgagcaacctgttggaggacaaggatggcaggtttcgtaccacatctccagatctcagccgcgacgcccttgcggttggaggaggcttagaagagcacggatcctcggcgatgaaccctgggcgctcaagctggggagttgaagcaggtcgatgatggcaatggcattgaccatgtaaggcggatgtagtgagatgctcagggttgttagtgccagttcgtcgctaatttgttgttttgttggagatttgaggtcactaatgttattagacttatgacctgtatggcggttgtttctggactatcttttcttcttcctcttaatttggggcgtcttccatgtccattgtttgaagcagtcggtttgtgacgtctctagcttggtactgtaaggttttgtctgtatataatcggagcagtaagcctaaaataggtttcggttgcttgggtttggatggtaatggttgtgaacaatgttgaacccttcgcattgcagtaaatgaacatcgtttgatcgg

SEQ ID NO: 9180 - DNA, 886 bp, Zea mays
ccgggcccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgccgccgcagccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctattactatgtctactttatgttgtcctaatggttgtaagtattttgggagtcactttgcttgcgaatgtctcgcgtaagacttatgtggtcaatggtcggttattaacttattaccatgaaagcacttcgtctgctgccctaagaggtttagtcccatttgcattataaccaattcaatccttgtggatgatttgtgtgattc

SEQ ID NO: 9181 - DNA, 853 bp, Zea mays
ccggggctccatatcccatccatcacagctagctagcgtacagacgaataatctcttcttcacctcactagctaacaccagctagcagctcgatcgctcttcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataatagtgaatacttttttgtcccaaaaaat

SEQ ID NO: 9182 - DNA, 1220 bp, Zea mays
ctcgaggccggccgggagaccgcagccggcaccatctcttgccgcaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcctttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatt

SEQ ID NO: 9183 - DNA, 1144 bp, Zea mays
ctcgaggccggccgggaactcctcctgcctgtgctctcctcctttttctccactccgcttttgcttggttccatcgggccggagaggagaagctagctaactagcagcagctctgttggtgtgtgtgtgtgtggagggtagctgcagctggggctagctggaaaggtcgggagccatggggaggggccgggtggagctgaagcggatcgagaacaagatcaaccgccaggtcaccttcgccaagcgccgcaacggcctgctcaagaaggcgtacgagctctccgtgctctgcgacgccgaagtcgcgctcatcgtcttctccaaccgcggcaagctatacgagttctgtagcggaccgagcatcacgagaacacttgagaggtacgaaaaaaacagttatgcaggcccagatactgctgtacagaacaaagagaacgagttagtccagaacagccgcaatgagtaccttaaactgaaagcaaaggtggataatttacagaggactcagaggaatttgcttggtgaagatctgggttcacttggtgtcaaagagcttgatcagcttgagaagcaaattgattcatccttaagtcacataagatccacaaggacacagcatatgcttgatcagctcactgatcttcagaggagggagcaaatgatgtgtgaagcaaataagtgccttagaagaaagctggaggagaccagcaaccaggtgcatggccaagtgtgggagcacggtgccaacttattactcggctacgagcggcactcttcaccacagcaagccccatcacatgttggcaatggattattctttcatcccctggaagctgcagcagagccaaccctgcagatcgggttcgctcccgagcatatgaataatttcatgccggcatggctaccctgaagatggatctttgaggcaaagggaataaataaagatgcgatgcatgtcagaatcatattgtactgcaagagtgacaattgtgtgttccactcacatatatgacctagttttgtgtgtctatatgtcgaaaccatatgtctgtgattttattatatgtaatgtaagcacagatgaaacatgcagggctagttgcttttgcttgtctatgtatctgtatctggctgtgcgccaaag

SEQ ID NO: 9184 - DNA, 1049 bp, Zea mays
ctcgaggccggccggaatcagttccacaatccacttgcctcggccgctatcgtgaccgggaacaacaactgcgagatggccacggtggagacctcgggcacggcgatagggtcctccgggagatgggcactacacggcaagacagccctcgtcaccggcggcacccgcggcatcgggcgtgcggtagtggaggagctggcggcgctgggggcggccgtgcacacatgctcccggaaggcggaggagctcggcgagcgcatcaaggagtgggaggccaggggattcagcgttaccgggtccgtctgcgacctctccgagagggaccagcgggagcggttgctccgcgaggttgccgaccgcttcggcggcaagctcaacatcctcgtaaacaatgtaggaacaaacataaggaaaccaactactgagtttactgcagaggaatactcgtttctgatggctactaatcttgaatctgcatatcacttgtgccaaattgcacgtcctcttttgaaattatctgggtcaggcagcattatattcatatcatctgttgctggagcgataggaatctttagtggaactatatatgctatgactaaaggtgccattaaccagctaaccaagaatttagcttgtgaatgggctaaggacaacataagagccaactctgtcgctccgtggtacatcaccacttcacttacggaaggaattttggcaaataagaactttgaggaacaagttgtgagtcgaactccgcttggacgtgtcggagaacctggagaagtatcggcacttgttgcttttctttgcatgccgggttccacttatattagcggccagacgattgcggtcgacggaggtatgactgtgaacgggttttaccctcccaagccctaggcggcagctgccatgtttctttgtgctgaggaaacgacaatagctgttgttcttggttgttgagaaaaaaaaatctaataaaatgtatgtaaaggtaaggttgtcatgttgatactgttcattacattacataattctatcagggcaatgtg

SEQ ID NO: 9185 - DNA, 818 bp, Zea mays
gaagcttatcgcttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 9186 - DNA, 1162 bp, Zea mays
tcccggcctgtcccctcacctccctccccctatctctccaccgccgcagctagctgcgacgtcatgcactcgccggcgccaccgccaccgcatactatctacaattagccagccgtaggcttacctatcctgtgtcaagcaagcctctcgcaagcaacaaggaaggaagctagctagttttatagctgctgtcggggcggcggctgaagcgacgtgcctgagctaggatttaggttgagatcaggagagggagaaggcggcggcgatggggcgcgggaaggtgcagctgaagcggatcgagaacaagatcaaccgccaggtgacattctccaagcgccgctcggggctactcaagaaggcgcacgagatctccgtgctctgcgacgccgaggtcgcgctcatcatcttctccaccaagggcaagctctacgagtactctaccgattcatgtatggacaaaattcttgaacggtatgagcgctactcctatgcagaaaaggttctcatttccgcagaatatgaaactcagggcaattggtgccatgaatatagaaaactaaaggcgaaggtcgagacaatacagaaatgtcaaaagcacctcatgggagaggatcttgaaactttgaatctcaaagagcttcagcaactagagcagcagctggagagttcactgaaacatatcagaacaaggaagagccagcttatggtcgagtcaatttcagcgctccaacggaagctcgcggagaagcagaaagaccagcggcagcaagtgcaacgggaccaaactcaacagcagaccagttcgtcttccatgtccttcatgttaagggaagctgccccaacaacaaatgtcagcatcttccctgtggcagcaggcgggagggtggtggaaggggcagcagcgcagccgcaggctcgcgttggactgccaccatggatgcttagccatctgagctgctgaaggtttgccctcaccgtcgcgatgtgatagcccaaaatccagcaagtcttccccggaccccggactgtccccgcttctccgcctggtgcagtatcgtcgtgatcgcgagaagcagcagcagcggtttgccgtattttttaccactgtgtataagtagcatatctgcaatgtgtatattttgttcaccgttcctgctggggc

SEQ ID NO: 9187 - DNA, 834 bp, Zea mays
atcgaggccggccggggaagcttatcgcttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 9188 - DNA, 1201 bp, Zea mays
ccgggaccccccattcgaacgccggagctcgacaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacctctgacatctcggaggaccctgctgaagagattagggaggcgcccaagcgggactcgagtgaggggcagtaaagccggctttatgtgcctagaaactagtagctagtgtttgctgctgtcgaatgacactatgcaatgtgatctggaacctggtttcttgggtgcgacgcttgtagccgtgttatgactgtcgtccgtaaaatttgggggctccccgtaagggatgctgcctggcaaggcctcggtgtcccacctcgtctgtggcgtggggcgctggagcccggtctggttgggttgggaagccctttaaactgttgtcacttgcattttaccttttccatcgctgtttattgtgagtggtcctatatcaatggctggtctcagtggtct

SEQ ID NO: 9189 - DNA, 1520 bp, Zea mays
ccggggagattcaatgaatccatctccatcctttcataacacacctgcaatcataaagagaggtgcaacgtcttctccgtgcttaccactcgccattcctaagtcctaactacctccacccccgcacgcacaactggccgcaccaaggcaaagctagaagaagacaacgcaaagggagaggacagaggaggagcagaggacgatgggcagcggcggcgctaacactgcccccctcatcaccccctacaagatgggaaaattcgatgtttcccacagggtagtcctcgcaccactgacgagacagcggtcctacggcaacgttcctcagcctcatgccatactgtactatcagcagagggcgactaaaggaggtcttctgatagctgaggccacgggggtttcagacactgcccaagggtacaaggacactcctggcatttggacccatgagcaagtcgaagcatggaagccgatcgtagacggggttcaccagaaaggagggatatttttctgtcagatttggcacgtagggagagtctccaattccacttttcagcctaatgggcaggctccaatttcaagcaccgataagccactaaagcctcaagtgagagccaatggtatagacgtggctactttcgcagttcctagacgcttagagactgatgaaatccctttggtcgtcaatgatttcagggtagctgctcgaaatgcgattgaagctggatttgatggtgtcgaaatccatggagctcacggttacctgattgatcagtttctaaaggacggggtcaacgaccgcacagacaaatacggtggcagtctggagaaccgctgccggtttgcactggaagtaactcaagccgtggtcgacgaaattggagctgacaaggtcgggataaggctgtcaccattcgctagctactcggaggcgccggactcagacccggaagctctgggcctgtacatggcgaacgcgctgaacgagttcgggattctctactgccacatggtggagccgcggatggtgaaactcggtgaaaagttcgaaaccccctacagccttcgcccgataagggacgctttcaggggaacgttcatcgttgccggcggctacggcagggaggatggaaatcgcgcgatctccactgggtatgctgatttggtcgcgttcgggcgcttgttcttggctaatcctgacctgcctcggaggtttgaagtagacgctccccttaacaagtacaacagagacacgttttacatccctgatccggttgttggatacactgactacccatttctttcgtcagatgtataaatgttctcttttcagcaatctgcttttttagattgagtagtaactggttggtgtaccagtaaaatattagaggaataaaccattggtctgaatgcctcattctcatatatatggacaaaagcaatatgatcgttgtaattgtgcctcaaatcttatagttgtaaaaaatattgtgaacaagatcagtcagttgtcaagttgg

SEQ ID NO: 9190 - DNA, 1095 bp, Zea mays
ctcgaggccggccgggcctttatagaggaagcagtggaaaagttgtggtacagttgtactgagctgagctgccggaggcagaataggagaggcaggcgatgacgatggcgacgaaggcggcgtgcgtgctggcggtgtgggtgctcgtcgcctcgggcctgtgcgacctgggctcagcgcgcgcgcccctgggcagcaagccgcagcgggagttcgactacttcgcgctctccctccagtggcccggcaccatctgcgcctccacccgccactgctgcgccaccaacggctgctgccgctcggagccgctccagacgttcacgatccacgggctatggccggactacgacgacgggacctggccgtcgtgctgccgccgcacccaattcgagatggacaagatattgccactgaaggaggtgcttgacaagtactggccgtccctctactgctccaaatctggaacatgcttcagcggcaagggactcttctgggctcacgagtgggagaaacatggaacctgctctgcccctgtggttcaggatgaattacagtatttcacccttgcccttgacctctactccaagtataacgttacggaaatgctgtcaagtggagggatacaggtttcaaatggtaaggaatatgcactgagcgatgtcatcgataccatcaaacatgcttttgggggatcgccacaaattgtttgcaagaggggttcaatcgaagaacttaggttatgcttcgacaaagaattgaagcctcgtgattgccttaccacttctttggcgaatggaagtgtatcaaaaagcaagcactgcccgcggtacatcaccttgccaacatatgatccccttgtgcttgccaattcaactgtagagatcatgacacagttcgatgaatttgatgtgcctgcagctctttatacagcttaaaatgcaattgttgcaatagcagaaggtgctcgcgtgagcacctagaaccaggcacatttatcctgggatattcaatcatttgtacatgtacacttgaaagagaactgacatcttttcaacctgaaaatttataagctttatgtaaccgtgaaggtcggac

SEQ ID NO: 9191 - DNA, 1851 bp, Zea mays
ccggggccgtctcctccctcactctcgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtcgaagcccttcgctggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgatccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccacagacgttatgatcgccggtaaggttgccgtggtctgcggatacggtgatgtcggcaagggttgtgccgctgcactcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccatttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtagcaggttttcttatggttatcgcttgagctgaggggggagggaaggagctgtttgcttttgctgaagaataatggtgtagtcggctggggtgaggcgatgtgcgttgccagatacagttttgtcttgttgactctacttatctgattatcatttgtaagcgatttgctcaagttatgtcgtttatgaataacttgctttcctcg

SEQ ID NO: 9192 - DNA, 1677 bp, Zea mays
ccgggaaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcctaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccagggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgtacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacagcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatgtatcgatcgagctcgccactgcgaagtctgagataatgcatgtatgcttgacggcgagatctgaggaaaaataatttctatatatgcatgtttcgagatggctctcccttaagg

SEQ ID NO: 9193 - DNA, 1660 bp, Zea mays
ccgggaaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcctaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccagggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatatatgcatgtttcgag

SEQ ID NO: 9194 - DNA, 985 bp, Zea mays
ccgggagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagc

SEQ ID NO: 9195 - DNA, 838 bp, Zea mays
ccggggaagcttatcgcttatcatccgcgcctctacatttcttctctctctgctcctccgcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttg

SEQ ID NO: 9196 - DNA, 821 bp, Zea mays
cctatcatctgcgcctctacatttcttctctctctgctcctccgcctccgcctgatccatccaagacagggatcgccatgtcggactcggaggagcaccacttcgaatcgaaggccgacgctggggcgtccaagacttacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttagatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgc

SEQ ID NO: 9197 - DNA, 841 bp, Zea mays
ccgggaatccccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccggcaacggcatccctcttcctaacgtcaactccaagatcctatccaaggtaatcgagtactgcaacaagcacgtacatgccgccgcagccgcagccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttcgtggtgtctactactatgtctactttatgttgtcctaatggttgtaagtattttgggagtcactttgcttgcgaatgtctcgcgtaagacttatgtggtcaatggtcggttattaaccttaccatgaaggcacttcgtctgctgccctaagaggtttagtcct

SEQ ID NO: 9198 - DNA, 916 bp, Zea mays
ccgggatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaagtgctggatctattgatgcctaagtttcgtggtgtctactactatgtctactttatgttgtcctaatggttgtaagtattttgggagtcactttgcttgcgaatgcctcgcgtaagacttatgtggtcaatggtcggttattaacttattaccatgaaagcacttcgtctgctgccctaagaggtttagtcccatttgcattataaccaattcaatccttgtggatgatttgtgtgattccatcgtgaatctcatggtaaaatattttcattgttgtg

SEQ ID NO: 9199 - DNA, 974 bp, Zea mays
ccgggaaaagcaaccaactttcttctccgtcacctgactcacacctccactcacctccggtccaccaacctctgccggccatggcggctgcggcggcgcagaagctcctcgaggcgagcacgaagatcatcggcgtcgggcgcaactacatcgcccacgccgaggagctcggcaacccgatccccaaggagcccgtactattcctgaagccgacctcgtcgttcctccacgctggcgtggccaccgccgccgtcgagatcccggagccgctcgaatcgctacaccacgaggtcgagctcgccgtcttcatctcccggcgtgggcgtgacattcctgaagcgtccgccatggacttcgtcggaggctatgcacttgctttggacatgacagcaaggggccttcaatctgttgctaagtctgcaggccttccatggactttggctaaagggcaagacaccttcactccaattagtgcagtagttccaaaatcatctgtcactaatcccgacgatctagagctgtggctaaaggtagatgatgaactaaggcagaaaggatcgacaagtgacatgatattcaagatcccttttctgatcagctatatcagctccatcatgacattaatggagggtgatgtgatactaacaggtactcctgagggtgtgggtcctgtgcgagtaggtcagaagatcaaagctggtataactgacctaattgatgtcgagttcgatgttcagaggcgcaaccggtcattttccacatgatacaataagcaagaaagtaacggccaaccgcttgaagattgctgctcgtgtcacgcgttcctcttgggtattcattcttccttgcgttgcagcgagattgcttcggcccatgagatgcgagtttagcctgtgcccactcatggcttaagcaaaatacctgctggccaatgttgtttacttgtactggtgatatattactgtgtaaaatag

SEQ ID NO: 9200 - DNA, 816 bp, Zea mays
ccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttgg

SEQ ID NO: 9201 - DNA, 821 bp, Zea mays
ccgggatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccacatgtgaaccgtactgagtaccagctgattgatatatcagaggatggatttgtgagccttcttacttcagatggcaacactaaggatgatcttagactcccaactgatgaaactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtagttgcaccgtgtctgcattatctgtggttacattctggaccctgtattttctatgcttttatgccccctactgtttagtattaattatcaataaatttgtttgggacggttgaacc

SEQ ID NO: 9202 - DNA, 1509 bp, Zea mays
ccgagacgaagtccactgccgagttgccgactcaccgactcccctcgcaagtcgcaatctccactctccagagtccaaactccactcctcaccgatgatggcctcgcaagcgatggtaccgctgcggcagctctttgtcgacggcgagtggcgcccgcccgcgcagggccgccgcctccccgtcgtcaaccctaccactgaggctcacatcggcgagatcccggcgggcacggcggaggacgtggacgccgcggtggcggcggcgcgcgcggcgctcaagaggaaccccggcggcgcgcccgccaacgtcgcctgcgccatcgccaagctcggcggctcctccgccttcgtcggcaagttcggcgacgacgagttcgggcacatgttggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggaggcggagctggacctgggcctggtgcggcgcgccagggtgttccactacggctccatctcgctcatctccgagccgtgccgctcggcgcacatggccgccatgcgcgcagccaaggccgcgggcgtgctctgctcctacgaccccaacgtgcgcctcccgctctggccgtcgcccgacgccgcacgcgagggcatcctcagcatctggaaggaggccgacttcatcaaggtcagcgacgacgaggtggccttcctcacgcgcggggacgccaacgatgagaagaacgtgctgtccctgtggtttgacgggctcaagctgctcgtcgtcaccgacggggacaagggatgcaggtacttcaccaaggactttaagggcagcgtgcccggcttcaaggtcgacaccgtcgacaccaccggcgccggcgacgccttcgtcggctccctcctcgtcaacgtcgccaaggacgactccatcttccacaacgaggagaagctccgcgaggctctcaagttctccaacgcctgcggcgccatctgcaccaccaagaagggcgccatcccggcgctgcccacggtcgccaccgcccaggacctcatcgccaaggccaactagatggccgcacgccccgccgttccaccacgtcactgtcccccgccgccccgcccctcgtcgtcgacgtcctcggtttcggttcattaggtagatcgagtcttagcgtccgtctctgcgcctctacgctgagacggtttgtttgggttaattaagttagctttcgtggagatttcgccccggggcatcaataaaatgttggcatgcgtggtgggatgctatccttttttttattttattttattttatttttagcttggatcagttggggttttgaacattgctagtgtcgtgtgattgggaaggctaatgtgatgccttcgatgcagagttttcaatgaatgccttggtgcaaacgt

SEQ ID NO: 9203 - DNA, 999 bp, Zea mays
ccgggagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgagacaatggacggtgcttcatccaacaatggagcggctacacaaggccccgtggcgatcaaaaaaaaggagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaagcgcctgcttgtacctagattactgtttccattgtcgtcgtcatcggctaacattgtcataatgtcagtttgggtaatgttagattaagtaattattgtgtccg

SEQ ID NO: 9204 - DNA, 1149 bp, Zea mays
ccgggagagagagagagagatagacaggagagagagagagaggggaagagagagagagagagagagagagagagatagatgtggtaactcaagaactgttcttatgcatgcagcagccataagcattgctactagggtttcatgcggggcgaagcagctggtctctgccgcctgaacgccgccggaatctgcgaggcctccccgagctgcgtgcgtcgtcagataaggcagccgccggcacggcaatgccggttccgcttgctccgtacccagctcctccggcgccattcacgccgcccaatggggcccagagccagctcgtctgcaccgggtgccggaacctcctcatgtacccagctggtgcgacgtcggtctgctgcgccgtctgcagcaccgtcaccgccgtgccggctccaggaactgagatggcgcagctagtatgcggaggatgccacaccctcctcatgtacatacgcggcgcgacgagcgtgcagtgttcttgctgccacactgtgaacctggctatggaagcaaatcaagtcgcgcatgtgaactgcgggaactgccgcatgctgctcatgtaccagtacggggctcggtccgtgaagtgcgcggtctgcagttttgtgacatcggttggagtaagtactcaaagcatcctttttcagaaaaggatgcaattaacaaataatgttttttgttgtagaagactaccattgtttcgctgctattcttactgtgaaacaacttgtgtttctcataagaaacagaaaactaaccgccgagtttcactctactcagacctcacctggtgcagagcagaagcccagcagctgagctgatagtgtccctgaaagtgctgtgagaccacctatgaaaaggatgctttgagtgcacatgtatagagttcttccctgaagcgattctttcactttcttttcttttgttttcttttgttttcttttcttttttggttcctcctcaccatctccaccccacccgtccacttctgcgttccttcgatggatctggcgagcccgcggaataaatgagagtttttggatatatagctagggcttaacctcgtcgacttgtctgtaaaatcgaatgagacacatatataaacctatgttgttttccttgtttctg

SEQ ID NO: 9205 - DNA, 1679 bp, Zea mays
ccgggaaggaaggagaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatccttttcgaggagacgctgtaccagtccgccgtcgacggccgcaagatcgtggacatcctggtggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacagcgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagctcggcaagtacacctccgacggcgaggccgccgaggccaaggagggaatgttcgtcaagaactacagctactaattaatcgcccggccatcacccgggataccgccgcccctccgagagatacgtgtgtactgatcatggttaagcacgtactccgatccattcccatcccatgaagccatgataatgatgatatgatccatggaccatgcatggtgctctggtcgatgccgtacgtgtgtccctgatacaatactattttagtactgatgctagtcatcatatatatcgatcgagctcgccactgcgaagtctgagataatgcatgtatgcttgacggcgagatctgaggaaaaataatttctatatatgcatgtttcgagatggctctcccttaatt

SEQ ID NO: 9206 - DNA, 1997 bp, Zea mays
ccgggaaaagtgtggaatgaagtgtggttatgtaaaccacactccactccagcactgaacacttgattgattcagtaggtagctagctagctgaatcacaatggatcctaccaagttccgtccgtccagtagccacgacacgacggtgacgacgacgaacgctggcgctcctgtgtggaacgacaacgaggcgctgactgtggggcctcgcggtcccatcctgctggaggactaccacctgatcgagaaggtggcgcacttcgcgcgggagcgcatcccggagcgcgtggtgcacgcgcgcggggcctccgccaagggcttcttcgagtgcacccacgacgtgacgtcgctgacgtgcgccgacttcctgcgcgcgcccggcgtgcggacgcccgtgatcgtgcgcttctcgacggtgatccacgagcgggggtccccggagacgatccgcgacccgcgcgggttcgccgtgaagttctacacccgcgagggcaactgggacctgctgggcaacaacttccccgtcttcttcatccgcgacggcatcaagttccccgacgtgatccacgcgttcaagcccaacccgcggtcgcacgtgcaggagtactggcgcgtgttcgacttcctgtcgcacctccccgagagcctgcacaccttcttcttcctcttcgacgacgtgggcgtgccgtccgactaccgccacatggaagggttcggcgtgaacacgtacacgttcgtgagcgcggcggggaaggcgcagtacgtcaagttccactggaagccgacgtgcggcgtgcggtgcatcctgacggacgaggaggcggcgctggtcgggggacggaaccacagccacgcgacgcaggacctgtacgactccatcgcggcggggagcttcccggagtggacgctgtacgtgcaggtgatggacccggacacggaggagcagtacgacttcgacccgctggacgacaccaagacgtggccggaggacctgctgccgctccgccccgtggggaggctggtgctggacaggaacgtggacaacttcttcaacgagaacgagcagctggcgttcgggccggggctggtggtgccagggatctactactcggacgacaagatgctgcagtgccgggtgttcgcctacgccgacacgcagcgctacaggctgggaccaaactacctgatgctgcccgtcaacgcgccgcgctgcgcgcaccacaacaaccactacgacggcgccatgaacttcatgcaccgcgacgaggaggtggactactacccgtccaggcacgcgccgctgcggcaggcggcgccgcccacgccactgccgcccaggccagtcgccgggaggagggagaaggccaccatacgcaagcccaacgacttcaagcagccaggggagaggtaccgctcctgggacgccgaccgacaggaccgattcgtgaggcgattcgccgactcgctcggacacccaaaggtcagccaggagctcaggtccatctggatagacctcctcgccaagtgcgacgcgtcgctggggatgaagattgccacccggctcaacatgaagccaaacatgtgatgcatcatgcttgtgctgaataataatgaagacgcatgcatgtcgtcgccaggaacaaagatcgagaaataatacaagaccagcacgcatgcatgggcatactctatatatatatatgtatagcccgtgcccgtgcccgcctttgtaccaatacaagccaaaccaagtggatgtgtattattattattattgcgctatcacatacatgtacccctgcctgctacctgaagatggatgtgtatcgagttatcaaattaaggcacagcagcagaaactatatgtattgcataagaatactcgtctcgatatggacatgattccctcagctgctaatttgaagctatatgcttcggaatatctcgtgtatcctcgttgtcttcttctgaatacaactgtgggcaagaagttgact

SEQ ID NO: 9207 - DNA, 2267 bp, Zea mays
ccgggatcgacgctgtggtcaccgaaccgcccacgtcacccccttccgtcctcccccgggacaatccccacgcaaccgcgcaccggagcggcggagcctgacgagtctacactagcggtggggcgagcaaaatctgcgccagttcgcctcgcctacttatacaccccgatcgcccccggtagttactcgacctcgctccctttgcctcctcccagctccggccccggctccggtttcacacagtaagcaaagatggcaccaccatccatgtgtcttgcggcaaagggggtgcttcccttctcggcacttatttcgagtggtgttacacaaaggccagtgtcagtgaccgcttccttggagcacaaaaccagcgatgctagaaggaagttcctaaaacttgcgcttgggaatatcggagttggactgcccaccttgttgggtgttaagaaagctctcgctgatgagcaaggaatctcgtcctcgaggatgtcttattcaaggttccttgagtatcttgacaagggtagagtgaagaaggttgatttatttgagaatgggacaattgctatcgtggaggccatttctcctgagcttggcaaccgcgtgcagagagtccgtgtgcagcttccaggtctaagccaggagcttcttcagaagttgagggaaaagaacatcgattttgctgctcacagcaaccaggaggactctggttctcttctgttcaaccttattggaaatttggcattcccacttattcttattggtggtctatttttactgtcaagaagggcacaaggtggccttggtggacccaatggccctggctttccccttggttttggtcaatctagggccaagtttcagatggaacccaacactggtgttacatttgatgatgttgctggtgtggatgaagcgaagcaagacttcatggaggtggttgagttcttgaagaaacctgaaaggttcactgctgttggtgctcgcattcctaaaggtgttctgcttgtcggtcctcctgggactggtaaaactttgcttgccaaggcaattgcaggagaggctggcgtaccatttttctcaatttcaggttctgagtttgtggagatgtttgttggtgttggtgcttccagagtacgtgaccttttcaagaaggccaaggagaacgctccttgcatagtgtttgtcgatgaaattgatgctgttggaaggcaaagaggtacaggtattggtggtggaaatgatgaaagggagcagaccttaaatcaactactaactgagatggatggttttgagggcaacactggaattattgttattgctgccactaaccgagctgacatcttggattccgctttacttagacctgggcgctttgacagacaggtgtctgttgatgttccagatgtacgtggaaggacagagattctaaaagtgcatggtggcaacaagaaatttgattctgatgtttctctcgatgtcatagcaatgagaacacctgggttcagtggagcagacttggcaaaccttctgaatgaagcagccattctggctagacggcgggggaggacagcaatttcttcaaaagagatagatgattctattgacagaattgtggctggtatggaagggactgtgatgacagacgggaagagcaaaagtcttgttgcttaccatgaagttgggcatgcaatttgcggaactttgacacctggccatgatcctgtccaaaaggttaccttaatcccaaggggtcaagctcgtggtcttacatggtttatcccgatggatgacccaacactcatctccaggcagcaactttttgccagaattgttggcggccttggtggtagagctgctgaggaggtgatatttggagagcctgaggtgaccactggagccgctggtgacttgcagcaaattactggcttagccaagcagatggtggtaacgttcggtatgtctgaaattggtccatggtctctgatggagggtggggcacagagtggggacgtcatcatgcgaatgatggcaaggaactccatgtcagagaagcttgcggaggacattgattcggcagtgaagcagttgtcagatgaggcctacgagatcgcattgaggcacattagaaacaacagggaggccatcgacaaaatcgttgaggtgctcattgagaaggagacactggccggagacgagttccgggcgattctttctgagtttgtggagatccctgtagagaaccgggttcccccagccacaccggc

SEQ ID NO: 9208 - DNA, 1111 bp, Zea mays
ccgggccatctcaagttctcaacctcattttcttaaaaaaaatctcaatcgcaacaacacaaaaaaggcccgcaatatcgattagcgagagtcgttcctccaccaaccaattcgcttctccgtcaacttcacttcctcgtcgacgcctccggcccaccaaccatgccggcggccatggcggctgcggcggcgcagaggctcctcgcggcgagcacgaaaatcatcggcgttgggcgcaactacatagcccacgccaaggagctcggcaatccggtccccaaggagcccgtcttgttcctgaagccgacctcgtcgtttctccacgctggtgtggccaccgccgccgtcgagatcccggagccgctcgagtcgctacaccacgaggtcgagctcgccgtcgtcatctcccggcgcgggcgcgacgttcccgaggcgtccgccatggactttgttggaggttatgcacttgctttggacatgacagcaagggaccttcagtctgttgctaagtctgcaggccttccatggactttggctaaaggacaagacaccttcaccccaattagtgcagtagttccaaaatcagctgtcactaatcccgatgatctcgagctctggctgaaggtagatgatgaactaaggcagaaaggaccgacaagcgacatgctattcaagattccttttctgataagctatatcagttccatcatgacattaatggagggtgatgtgatactaacaggtactcctgagggtgtgggtcctgtccgagtaggtcagaagattacagctggtataactgacctaattgatgttgagttcgatgttcagaggcgcaatcggtcattttccacatgatgcaataagcaagaaagtaatggtgaatacaaagtgcagtactcgtcctcgaccttgaatcgcattactggacctggagccattgcagatagctcttgagccttaccttgatttaatttacctgggttttgagagactatctatgaatatgctaactcgttcgtaaagtatctttttgtcccaattttgattgatggagctttaagcttgcttttctgtatgcaataaaaaaacttatcacatttttctttcc

SEQ ID NO: 9209 - DNA, 1120 bp, Zea mays
ccggggccgcaccccccattcgaacgccggagctcgacgaggacgaccgacgacgcacgcagagatccggcgtactgcaaattttgaaaactgaactgtaagatggcatcagcagagctttcccgtgaggaaaatgtgtacatggcgaagctcgccgagcaggcggagaggtacgaggagatggttgagttcatggagaaggtagccaagactgttgactcggaggagctcactgtggaggagcgaaacctcctgtctgttgcatacaagaacgtcattggagcccgccgcgcctcatggcgcatcatctcctccatcgagcagaaggaggagggccgaggcaatgaggaccgagtaacactcatcaaggattatcgtggcaagattgagactgagctgaccaagatctgtgatggcatcctcaagctgcttgagacccatcttgtgccgtcttccactgctcccgagtccaaggtcttctatctcaagatgaagggtgattactacagataccttgctgagttcaagactggagctgagagaaaggacgccgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgctgaagagattagggaggcgcccaagcgcgactcgagtgaggggcagtaaagccggctttatgtgcctagaaactagtagctagtgtttgctgctgtcgaatgacactatgcaatgtgatctggaacctggtttcttgggtgcgacgcttgttatgactgtcgtcagtaaaatttgggggctccccgtatgagatgctgccgggcaaggcctcggtgtcccacctcgtttgtggcggggggcgctggagccggtctggttgggttgggaagccctttaaacc

SEQ ID NO: 9210 - DNA, 821 bp, Zea mays
ccgggacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccacatgtgaaccgtactgagtaccagctgattgatatatcagaggatggatttgtgagccttcttacttcagatggcaacactaaggatgatcttagactcccaactgatgaaactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtagttgcaccgtgtctgcattatctgtggttacattctggaccctgtattttctatgcttttatgccccctactgtttagtattaattatcaataaatttgtttgggacggttgaaaaaag

SEQ ID NO: 9211 - DNA, 1831 bp, Zea mays
ccgggacgaactggcgtgccagtgccagtgccgagcgcccgagcccttactcctcttcttccgaccccccgctggcttggaaaaaaggggaagaaaactcgcgcagtcggtcaccgaagggaggagcgcggtcgaggtgccgcccacacggagctgcgaggtgtttgtaggatctcctaggtgagcccctgctgcttggagacagccatggccaccggcgtggctccagctcctctcccacatgtcagagtgcatcatgggggcgtcgggttcaccaggagcgtcgattttgcgaaggtcttgtctgctcccggtgccggcacgatgagggcaagctcctctagaggcagggcgctcgtggcgaagagctctagtactggctcggagaccatggagctcgagccatcttcagaaggaagcccacttttagtacccaggcagaagtactgtgaatcaacacaccagacaaggaggaggaaaactcgaactgtgatggtggggaatgtgccacttggcagtgatcatcccataaggattcaaaccatgacgacttcagataccaaggatgttgcaaaaacagtagaggaggtgatgaggatagcagataaaggagctgatcttgttagaataacagtccagggtaggaaggaagctgatgcctgctttgagatcaagaacactctggttcagaagaattacaacattccactagtggccgatattcattttgctcctacggtagccctaagggtggcagaatgttttgacaaaattcgtgtgaacccaggaaattttgctgatcgtcgtgctcaatttgaaaagctggaatatactgacgacgactaccaaaaagagctagagcatattgagaaggtgttttctccattagttgagaaatgcaagcagtatggaagagcaatgcgaataggaacaaatcatggtagtctttctgaccgcataatgagctactatggtgattctccacggggaatggttgagtctgctttggaatttgctagaatatgtcggaagttggacttccacaactttgtattttcgatgaaagctagtaaccctgttatcatggtccaagcatatcgcctgcttgtggcagaaatgtataacctaggatgggattatcccttgcacttgggtgttacagaagctggagagggtgaagatggaaggatgaaatctgctattggcattgggacactgctaatggatggtttgggtgatacaatccgtgtctccctcacagaaccaccagaagaagagattgatccttgccaaaggttggcaaatcttgggacgcaggccgcaaaccttcaaattggggtggccccatttgaagaaaagcacaggcgttattttgatttccagcgtaggagtggtcaattgcctttgcagaaggagggtgaggaagttgactacagaaatgtcctgcatcgtgatggttctgtactgatgtcagtttccctggatcagttgaaggctcctgatctcctttataggtctcttgcagcaaagcttgtggttggcatgcctttcaaggatctggctactgtagattccattcttttgagggagctcccccctgtagaagatgctgaagctaggcttgcactcaaaagattagttgacatcagcatgggcgtactggcccccttatcggagcagttgacaaagccactcccacatgcaattgtacttgtcaacctcgacgaattgtcaagtggtgcacacaaacttttgccagaaggcactagactagctgtcactcttcgtggtgatgaatcatacgagcagctagatattcttaaggatgttg

SEQ ID NO: 9212 - DNA, 1660 bp, Zea mays
ccgggaaggaaggagaagaagacgagtgtcaagtgaacctgaaatttgcggtgtcactggctggtatagcctgagtgtgagtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagcttggcaagtacacctccgacggcgaggccgccgaggccaaggagggaatgttcgtcaagaactacagctactaattaatcgcccggccatcaccgcccgggataccgccgcccctccgagagagatacgtgtgtactgatcatggttaagcacgtactccgatccattcccatcccatgaagccatgataatgatgatatgatccatggaccatgcatgcatggtgctctggtcgatgccgtacgtgtgtccctgatacaatactattagtactgatgctagtcatcatatatatcgagctcgccactgcgaagtctgagataatgcatgtatgcttgacggcgagatctgaggaaaaataatactatatatgcatgtttcg

SEQ ID NO: 9213 - DNA, 1658 bp, Zea mays
ccggaaaaaggagaagaagacgagtgtcaagtgaacctgaaatttgcggtgtcactggctggtatagcctgagtgtgagtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcgaaaacgatcgcgtcgccggggcggggcatcctggcgatggacgagtcgaacgcgacgtgcgggaagcggctggcgtccatcgggctggagaacacggaggccaaccggcaggcgtaccgcacgctgctggtcacggcgccgggcctgggccagtacatctccggcgccatcctcttcgaggagacgctgtaccagtccgccgtcgacggccgcaagatcgtggacatcctggcggagcagggcatcgtgccggggatcaaggtggacaagggccttgtcccgctcgccggctccaacaacgagtcgtggtgccagggcctggacggcctggcgtcccgcgaggccgcctactaccagcagggcgcgcggttcgccaagtggcgcaccgtcgtcagcatccctaacggcccctccgagctcgccgtcaaggaggccgcgtgggggctcgcacgctacgccgccatctcacaggacaacgggcttgtgccgatcgtggagccggagatcctgctggacggcgagcacggcatcgagcgcacgttcgaggtggcgcagaaggtgtgggccgaaaccttctacgccatggcggagaacaacgtcatgttcgagggcatcctgctgaagccgtccatggtgacgcccggcgcggaggccaaggacagggccaccccggagcaggtggccgcgtacaccctcaagctcctccaccgccggatccccccctccgtgcccgggatcatgttcctctccggcgggcagtcggaggtggaggcgacgcagaacctcaacgccatgaaccaggggcccaacccgtggcacgtgtccttctcctacgcgcgggcgctgcagaacacctgcctcaagacctggggcggccagccggacaaggtcaaggcggcgcaggacgcgctgctgctgcgcgccaaggccaactccctggcgcagcttggcaagtacacctccgacggcgaggccgccgaggccaaggagggaatgttcgtcaagaactacagctactaattaatcgcccggccatcaccgcccgggataccgccgcccctccgagagagatacgtgtgtactgatcatggttaagcacgtactccgatccattcccatcccatgaagccatgataatgatgatatgatccatggaccatgcatgcatggtgctctggtcgatgccgtacgtgtgtccctgatacaatactattagtactgatgctagtcatcatatatatcgagctcgccactgcgaagtctgagataatgcatgtatgcttgacggcgagatctgaggaaaaataatactatatatgcatgtttcg

SEQ ID NO: 9214 - DNA, 859 bp, Zea mays
tcgaggccggccggggaagcttatcgcttatcatccgcgcctctacatttcttctctctctgctcctccgcctctgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatt

SEQ ID NO: 9215 - DNA, 710 bp, Zea mays
ctcgaggccggccgggatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggccggcgtcaccatcgcgcacggcggcgtcctccccaacatccactccgtgctcctgcccaagaaggcggcggagaaggcggccagcggcggcagcaaggagcccaagtcccccaagaagggcgccaagtcccccaagaaggcttagaaagtagggtcttcatttgcgctgtgtgctgtagcatgttcgtgtctagatctgtggatgggatgtgtcctgctctagtatcgtccttgtgtcttattgtatgttcgtcttcatcgagaagatcttcagcagtc

SEQ ID NO: 9216 - DNA, 1011 bp, Zea mays
cgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagtcaccctctgtaccgtgagtctgagcttatccaggagaactaccttggtgtgagaaatgcagcacagaggaagctactggatgagctgggcatcccagcagaagatgccccagttgaccaattcacccctctgggccgaatgctttacaaggcaccatctgatgggaaatggggggagcatgagctcgactacctgctgttcatcgtccgggacgtgaaggtgcagccgaacccagatgaagtcgctgatgtgaagtacgtgaaccgcgaggagctcaaggagctcatccggaaggctgacgctggcgaggatggggtgaagatctccccctggttcaggctggtggtggacaacttcctcatgggctggtgggaccatgtcgaggaaggcaccctcggcgaggccgtggacatggagaccatccataagctgaaggagtgaggggacgccggcctgccgtctccgatgacctcaccgcctgctgctgctgctgcactgcatgtttatcaaaagttatcgctcctgctcgcggaaagtgagcttgactgttgccggggtggaagtatcgttttggactgatgcatgagtgctgcggaggggtttgttgtttgtttgtttgttcggtgaccgaatcgcgagctggacgcctgtttaatccgtgcttatacatcgtctgagtaaacaac

SEQ ID NO: 9217 - DNA, 835 bp, Zea mays
atcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtct

SEQ ID NO: 9218 - DNA, 668 bp, Zea mays
ctcgaggccggccgggagaagccggccgggaaaaaaaaaaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaggcgggcaatgtgattggctgtgtatctgcttcgctc

SEQ ID NO: 9219 - DNA, 675 bp, Zea mays
ccggagtagccaccattccgggtttggtgctggccggtgtcgtacgactccggtcgtccatggggaggtctccttgctgcgacgagaatggcctgaagaagggcccctggactcaggaggaagacgagaagctgctgcactacatccagaagaacggacatggtagctggaggaccctgccgaggctggccggtctgaaccgatgcggcaagagctgccggctgcgctggaccaactacctgcggcccgacatcaagcggggcaagttctcgcaggaggaggagcagaccatcctccacctccactccgtcctcggcaacaagtggtccgccatcgccacgcacctccccggccgcaccgacaacgagatcaagaacttctggaacacgcacctcaagaagcgcctcatccagatgggcttcgaccccatgacgcaccgcccgcgcaccgacttgttcgccgcgctgccgcagctcatcgcgctcgcagccctccgcgagcagctgtccgccctctgctcgccgcaactgactgctgctacgactgccccgtccgcggacgacggcgaccgccagtcgtcgtacctaccgtgcacgttccccgtcagtagtgacggtcaagaagctgccaaccagcaacagcaaacaggcctcatcagctatgacggcggccctc

SEQ ID NO: 9220 - DNA, 989 bp, Zea mays
ccgggcgagtgccctagtaaccctagccgcctgaggccgacgccaaatctctcctgaccgcaacggggaactcgacccccgcctccgccaccgccaccgcgccggtcgccgacccactcagatgaacacgtctccgtccagatacagtgaacgcagggagcccactggatgtctcaaagagggccaggatgatggaaccaggtgctccctattttggggctatgggaagcagcgccagcggtgccggcggcggcttctaccagccctttaacagcaacctagctggtgcagggtctagcaccggtatccaaagcttcccatgtgtccggctgcgaggccttccctttgattgcaacgacattgacgtctgcaagttctttgtggggctggacatagtggactgcctcctggtcaacaagaacgggcgcttcaccggcgaggctttcgtggtcttcccaacatccatgcaggcagagtttgcgctgcatcgcgacaggcagaatatggggcggaggtatgtcgaggtgttcaggtgcaagaagcacgagtactactgcgcaatagccaatgaggtgaaccagggcggttatttcgagccggagtaccgtcgctccccgcctcctccgaggcctaggaagccgtctgaagataagggcagcatggagtacacagaggttctgaagctccgcgggcttccctactctgccaccactgaggacatcatcaagttcttcctggagtacgagctggcagaggagaacgtgcatatcgcctaccgcaccgatgggaaggccacgggtgaagccttcgttgagtttccgacagctgaagtcgcgaagacggccatgtgcaaggataagatgaccattgggacgaggtacgtggagctgttcccgtcgaccccagaggaggccagcagggcgaaatcccgaggcaggcattgaagaaacgtgttccagtgatcttctgtatgcatgcatgcggccctc

SEQ ID NO: 9221 - DNA, 1266 bp, Zea mays
ccgggcaacgcgcatcactcgctttaaatccgcacctcccggccggtccccttatcacctcaccttctcctttgagtcctctctctccgccgccgcagctagctgtgacgttatgctctcgccggcgccatagcgccagcgcctaccgtctacaactatccagccttaggcttacctatcccgtcaatcaagcctctcgtaaggaacaaggaaggtagctagctagttctatagctgctgtcgtcgtcgtcatcggcggcggcggcgcctgttcttagaggataaggttgtcctagcggagagggagctagccaggatttcggttgagatcaagagggggagcaggcggcggcggcggcgatggggcgcgggaaggtgcagctgaagcggatcgagaacaagatcaaccgccaggtgaccttctccaagcgccgctcggggctgctcaagaaggcgcacgagatctccgtgctctgcgacgccgaggtcgcgctcatcatcttctccaccaaagggaagctctacgagtattccaccgattcatgtatggacaaaattcttgaccggtacgagcgctactcctatgcagaaaaggttcttatttcagcagaatctgaaactcagggcaattggtgccacgagtatagaaaactaaaggcgaaggtcgagacaatacaaaaatgtcaaaagcacctcatgggagaggatcttgaaacgttgaatctcaaagagcttcagcaactagagcagcagctggagagttcactgaaacatatcagaaccaggaagaaccaacttatgctcgagtcaatttcggagctccaacggaaggagaagtcgctgcaggaggagaacaaggttctgcagaaggagctcgcggagaagcagaaagcccagcggaagcaagtgcaatggggccaaacccaacagcagaccagttcgtcttcctcgtgcttcgtgataagggaagctgccccaacaacaaatatcagcatttttcctgtggcagcaggcgggaggttggtggaaggtgcagcagcgcagccacaggctcgcgttggactaccaccatggatgcttagccacctgagcagctgaaggtttcagcaactcttcccgtttatccgcctggtgcagtatagtatcatcgtgatcgcgagagcagcagcagtgggtttgccgtatctttttttaccaatgtatgtctatatatgtaagtatcaaatctgcaatgtgttaatcaccatttccgctggggcggccctc

SEQ ID NO: 9222 - DNA, 1393 bp, Zea mays
ccgggaaccgagacgggacgagtccagcagccggccaccagcccatccgaaccctgctgcccccctctccgggttcgcgtgaggctgtgtgctgctgggaggagggagggggaagcggcggcggggcgccatggaggccgagaagaaggcgccggcggtgtcagacgtgggcgcgtgggcgatgaacgtcgtcagctccgtcagcctcatcatggccaacaagcagctcatgtcctcctccggctacgccttcgccttcgccaccacgctgaccgggttccacttcacggtcacggcgctcgtcgggtggatctccaacgccaccggctactccgtctccaagcacgtcccgctctgggagctcgtctggttctctctcgtcgcaaacacctccatcaccgggatgaacctcagcctcatgctcaactccgtcggcttctaccagatctccaaactgagcatgattccggtggtctgcctcatggaatgggtgctgaacagcaagcactacaccaccaaggtcatctcggcagtggttgtcgtggccgccggtgtcgggatttgcacggtcacggatgtcgaggtcaatgccaaggggttcatctgcgcttgcgtggcagtgttctgcacgtcgcttcaacagattacaattggttcctttcaaaagaagtacaacattgggtcatttgagctgctgagcaaaactgcaccaatccaggcaatttcactcattatactgggcccctttgtggactactatctaaatggacggtcattgttgaactaccctttttcgggaggggcaactttcttcatcttgctttcctgctccctggccgtcttctgcaacatgagccaatacctatgcatcggccggttctcagcgacctcgtttcaggtcctgggccacatgaagaccgtgtgtgtgctgatcctcggctggatcctgtttgactcggccctcaccgtgaagaacatcctcgggatgctgctcgccgtgatgggcatggtggtctacagctgggccatggaagcggagaagaaggcggcagcccctgtcccccggatcaagagcgaaatgctcgacggcgaggacgtacccctcaaggccagggtgagcggcgtgcccgcggtcgacctcgaggacggcgagatgaagagctagctgctgctgccgccgctgattcgttcattcttcttgttcttttgtaactgtgcgcgcgcgatcgctcgatccaaagttgcttgtccgtcagctctcagctatcgacactacactgttaattttggccccttgttggggagagtccagttcctaggtgacgacgaccacccccagttcggcgtagatcaaacacacactagcagaatgcagatttttaggatttttttc

SEQ ID NO: 9223 - DNA, 675 bp, Zea mays
taccctcgaggccggccggggtttaatcaatccttcaagcgcaagctgcctcctcctcgtcgtccggtcgtgagaagggatggcgggccgtggcaaggctatcggcgctggcgccgcgaagaaggcaacgtcgaggagctccaaggccggactccagttccccgtcggcaggattgccaggttcctcaaggcgggcaagtacgcggagcgcgtcggcgccggcgcccccgtgtacctcgccgccgtcctcgagtacctcgcggctgaggttctcgaacttgccgggaacgccgcgagggacaacaagaagacccgcattgtgccgcgccacatccagcttgctgtgcgcaacgacgaggagctgaccaaactgttgggtggtgccaccatcgcgagcggaggtgttatgcctaacatccatcagcatctgctccccaagaaggctgcctcctccaaggccagtgtcgacgacgacgacaactgagactgcttcctgcagaaatgatccgaccaccgccttgttttgtaggaataggatgatgttgtcttcggggaggagtcgggtttgttgggaaggaaaattagattagtatcagtttttttgaatgggatgggaacgtggctgtgaatctcagggttgtatgctcgttgagaaagaaatggaaggacttcgtg

SEQ ID NO: 9224 - DNA, 818 bp, Zea mays
gaagcttatcgcttatcatccgcgcctctacatttcttctctctctgctcctccgcctccgcctgatccatccaagacagggatcgccatgtcggactcgggggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaggaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttag

SEQ ID NO: 9225 - DNA, 802 bp, Zea mays
atcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttgg

SEQ ID NO: 9226 - DNA, 1548 bp, Zea mays
ctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaagaaaaacgctcaagctgcaggagttactgctcattactacgaggatgagactgctcctactggcacatgtgctgtatgtgttgttggtggtgaaaggtcattgattgcaaatctgtcagcggcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaggagattgctttgaagatctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcatacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacgagatgtttttgattgcgttttgctttgttcctagcaggccagcaaggtagcatcagccttgccctaagttgaaggccgccatctatttatatgttgcagtcatcgatcaatccaattagataacttgctgtttctttttcataaatgagtgttttgtgtgccattgaatacaggtaaaagttatcttgtgcc

SEQ ID NO: 9227 - DNA, 1902 bp, Zea mays
ccgggggatgaatctctagcgcgcgacctgctcctcctccgtctcccccgcgccgcgtgccctagagacgaaattctctctctcctagagccgccgccgcagccaaaaaaaaaacccctaaacccccaatccatggcgtcgagcagcactgaccttgccgacgacggcttcgcggcgccgcgacttttctcgcagggtgtatcctacacatacgacgacgttatcttcctcccgggctacatcggcttccccgccgacgccgtcgacctctccacccgcctctcccgccgcatcccgctatccatcccctgcgtcgcgtccccgatggacactgtctccgaggccgctatggccgcggccatggcatcactcggcgccgccgctgtcgtgcactgcaacaccgatccccacgctcaggccgccatcgtccgcgctgccaagtcccgccgccttcccttcgtttcctccgtgccctttttctccccgtcctccgccccgacgctcaacgatttcgctggcaccgagtacgccctcgtcaccgagcgcggagattcgctctccaggctcgtcggcgtcgctgtcgcggccgatgctgcctcccgcgaggttcccgtctctgtctcggagtacatgcgaccgacgccgcgctcagcctccgccgccttcgactttgaggaagcagcaaccttccttgccgatgagggtctggattacgcccctctcgtatcagatgatggtgaggttgttgatctaatcaccgccaaggacgtggagcgcatccggagctatcccaagctgggcaagccgtctcttggagccagcgggaagtttgtagttgcggcttccattgggactcgtgaagatgacaagggaagactggagcaactagttaaggcgggggcaaatgctatcgtgattgatagttcacaggggaactccatataccagctcgatatgataaagtttgcgaagaagatgtatccggaggtggatttgatcggtggtaatgtggtgacaattgcacaggcccagaatttgattcaagctggtgtggatggattgcgtgttggaatgggatcgggctcaatttgtaccacccaagaggtttgtgctgttggaagaggacaggcaacagcagtatataaggtttcatcttatgccaaggatcacaatgtaccggttattgctgatggtggaatttcaaactctgggcatattgtgaaagctctgtcgctgggggcatccactgttatgatgggcagctttttagctggtagtcatgaagctcctggtacttatgagtataaggacggccgccgagtcaaaaaatacagaggcatgggctctcttgaagccatgacaaaagggagtgatgcaaggtaccttggtgatacactcaagctcaaagtcgcgcagggcgttgttggagcagtagctgacaaaggttctgtactgaggtttattccttacacaatgcaagcagttaagcaaggattacaagatcttggtgcagattctctccagtcagctcatgatcttttgcggtcagagacactcagattagaggtgagaaccggtgccgcccaggctgaaggaggtatccatggactggtttcatacgagaagaaggcattctaggtccataactaaacaaagaagtattggaacgatagtggttagctgcatgatatggaagggggcgatgctcatttatcctacctggcaaaagctcagcagcttgtcagcaaagcttgtcgagttgggcagcaagtgtaccatctgcttggcgtcatataataataaacctctggcatcggaactgttgtataagctcacagcttgtcatctaaacatttttcccaattttgttaaaagagtaaaacatcaatggttgattgatct

SEQ ID NO: 9228 - DNA, 834 bp, Zea mays
ctcgaggccggccagggctccatatcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaatt

SEQ ID NO: 9229 - DNA, 860 bp, Zea mays
ctcgaggccggccggatatcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccattacatc

SEQ ID NO: 9230 - DNA, 840 bp, Zea mays
cgaggccggccggggagcttatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttgaattgcatgcac

SEQ ID NO: 9231 - DNA, 584 bp, Zea mays
ctcgaggccggccgggagcctctggccgctgcccgaccccgacgcctgctgcccaggtcttcgccggcgacgagcactccaccagacgagaggggattccaagatgccgagggccaccagcgacgcgaagctcctgatccagtccctcggcaaggcgtacgctgccacaccaacaaatctcaaggttgcttacatgggattggttgggtcgtttcccttcaactccttcctctcaggagtcctttcatgcataggaactgcagttcttgctgtttgcctccgcattcaagtgaacaaagacaacaaagaattcaaggaccttcccccagaaagggcctttgctgatttcgtcctatgcaatctggtgctccacctggtgatcatgaatttcctcggataagcaactgctgcaccatgttggttaaaggttttgtagccccaggttgtggtcgctgattgttgcctttaaatgtttggaactgttgtgatcgtgatgtcgaatatccatatgatctgttgaaggattacttgtgtaagctgagtattcccggagggaactattagtcgaatggacagtttgccct

SEQ ID NO: 9232 - DNA, 818 bp, Zea mays
ccgggaacagaacccaaacctcgccgattcgctccccttcctcaccgcgcgcgtacgccgccgctgcgctcaccttaacgaaccctaaacctgagccaccgccctcccccggaggtccgccgctccgtgtgggactctaggcgtcgccggagccccctccaggggctagcggcggaggaagtcggaaaccgattacccctcccctccccttaccgggggagggagaaactagcggaggaggcgaatcaggtcagagtggggcacgatgaggatcatgatcaagggaggcgtgtggaagaacacggaggacgagatcctcaaggcggccgtgatgaagtacggcaagaaccagtgggcgcgcatctcgtcgctgctcgtccgcaagtccgccaagcagtgcaaggcccgctggtacgagtggctcgatccgtccatcaagaagaccgagtggacaagggaggaggatgagaaattacttcatcttgctaaactcatgcctactcagtggaggacaattgcacctattgtaggtcgaacaccatctcagtgtcttgaacgttatgaaaagctgcttgacgccgcatgtgcaaaggatgaaaattatgaggctaatgatgatcctaggaagctgcggcctggcgagattgacccaaaccctgagtcaaagcccgcacgtcctgatcctgttgatatggatgaagatgaaaaagaaatgctttctgaggctagggcccgcttagctaacactaggggtaaaaaggccaaacggaaggcaagggagaaacaacttgaagaagcaagaaggcttgcttcactac

SEQ ID NO: 9233 - DNA, 1938 bp, Zea mays
ccgggagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcggcgcgcgacctgagagcacagcagcaccggaccggctcaggcaggcgaccggcagaaaagatggcgggagcagcagctgtggagacggcggcggcggcggcggcggcggcggcagcggccaacggaaaagcgtgctgccacgccgccaaggggcccgggtacgccacgccgctggaggccatggagaagggccccagggagaagctcgtctacgtcacctgcgtctacaacggcactggaattaacaagccggattaccttgcgacggtggatttggatcccagctctcctacatactcccaggtgatccacaggctcccggtcacccacatcggcgacgagctgcatcactctggctggaactcctgcagctcctgccacggtgacccatcggccaagcgccgcttcctgatcctgccttccttgctgtcaggccgtgtgtatgtcgtcgacacagcgacagacccaagggcgccatccttgcataaggtggttgagtctgaggacattgctgagaatactgggcttgggttccctcacacgtctcattgccttgcgtctggcgacattatgatttcttgccttggggacaaggaggggaatgcagctggcaatggcttcctgctgttggattcagagtttaatgtcaaaggacgttgggaaaagccaggtcacagtcccttgtttggatatgacttctggtaccagcctcgccacaagacgatgatcagttcctcatggggagcccctgcagcctttaggacaggtttcgatcttcaacatgtccaggatggcctgtatggaaggcacctgcatgtgtacgactggcctggcggtgagctcaagcagacacttgatctaggtgacactggactccttccccttgaggtgaggtttttacatgatccatcaaaggacactggctatgttggctgtgctttaacaagcaacatggtgagatttttcaagaccgcggatggatcgtggagccatgaggttgctatctctgtgaaaccactgaaggtccgcaactggattctgccggaaatgccaggattgataactgattttgtcatctctcttgatgaccgttatctctactttgtaaactggcttcatggcgatattaggcagtacaacattgaggatcccgcaaagcctttcttggctggacaagtatgggttggtggtcttcttcagaagggcagtgatgtcgtctatgttactgatgatggtcaggaacagcagtataatgtgcctcaagtcaagggtcatcgacttagaggtgggccacagatgattcagctgagcttggatggcaagaggatatacgtgacaaactcacttttcagccgatgggatgagcagtttttcggtgatgatcttgtcaagaagggctcccacatgttgcagatcgatgtcgacaccgagaaaggaggcctggctgtcaaccccaacttcttcgtcgattttggcaccgagcctgatggtcctgccctggcccacgagatgagatatcctggtggggactgcacctctgatatatggatctgaggtcaaggattcggcgtaattaactggctgctggagaatccctgttgttgtatgcactgtaattaacatggtatccgtgcggtgttccgtcttgtactgcgactgttgccagtggaataaggcatggtttcatgagaactctagattaataaaagaagtcctgattcc

SEQ ID NO: 9234 - DNA, 877 bp, Zea mays
ctcgaggccggccgggatgagttgcagaggtagaggatggatatcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcgactgatcgatggatccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtcc

SEQ ID NO: 9235 - DNA, 831 bp, Zea mays
ccctcgaggccggccgggatatcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaact

SEQ ID NO: 9236 - DNA, 840 bp, Zea mays
ctcgaggccggccgggaatcccatccatcacagctagctagcgttcctaatcaccgacgaataatctcttcttcacctcactaacaccgagctagcagctcgctctgtcctgcaacaatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcggcggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaaccatagtggaggtagctcgctcgttggatggcagcgtacgtggccatcagcagcatgcagtcgtcgtcgtagcagagatgtcctagctacgtgtgtgtcatgcatcagactggcacataataaagaagtagatcatgcacccactagtgatcacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaat

SEQ ID NO: 9237 - DNA, 1633 bp, Zea mays
ccggggttcccattaatatctagccgcctctccccccgtctcttctcctcctccaaaactgtgagcgagaggcagggagtgcgctcgacggccgccgccattagtgatttagtgttgagagagggagataatctaaagtgaccggacgctgtcctcccttgctgatcggcgacacggtccatccctccctcgctcgctagggttccttttcgtccatggatcagagcttcgggaatctcggggccggagctgggagcagcagcgggggctccaactccaaggcggcggcagcggccgtgtcctcctcgtctttcctgcagctgccgctgtcgacggcgtcccccgcgtactacggcgcgccgctcgcgcttctgcaccacgccgccgcggccccgtcgtcgtcgcagcagcagcagcagcagcaccaccaccagtacgccaggcacggcgccgagatgtcggcggcggaggccgaggccatcaaggccaagatcgtggcgcacccgcagtactcggcgctcctcgccgcctacctcgactgccagaaagtgggcgcgccgccggacgtgctggagaggctgacggccatggcggcaaagctggacgcgcgcccgccgggccgccacgagccgcgcgacccggagctggaccagttcatggaggcgtactgtaacatgctcgtcaagtaccgggaggagctcacccggccgatcgacgaggccatggagttcctcaagcgggtggaggcgcagctcgactgcatctccggcggcggcggctcctcctcagcgcgcctctcgctcgccgatggtaaatcagaaggggttggctcttctgaagatgacatggacccgaatggtcgcgagaacgatccgccggagattgacccacgagcggaggacaaggagctcaagtaccagctgctgaagaagtacagtggctacctgagcagcctcaggcaggagttttccaagaagaagaagaaagggaagctcccaaaggaggccaggcagaaactcctccactggtgggagctgcactacaagtggccgtacccttcagagacggagaagattgcgctcgcagaatcaacgggcctagaccagaagcagatcaacaactggttcatcaaccagaggaaacggcactggaagccgtcggaggacatgcctttcgtgatgatggaaggcttccacccgcagaacgccgctgctctgtacatggacgggccgttcatggccgacggcatgtatcgcctcggttcatgaactacacttccatggacgactgtgtggggcctatatatccaatcgtcggaccgtgggagtatatttcagtgtaccaggaccaggatgcgttgcagtgcaaggacattgttgtggaatttttgttgctgattgccaaggggtgggtcggtcgatgtagcgtctatgcatggcttgtagttctcctgtaatgttgttgttaatttccgcttggcggcttgtaatcttaggtgtatctggaacttgaatcctgggtgattaatccggcaagcagctgcctgtttgtatgattgtatggttcgggttggtggaacatgatgcatgctaaggcgtggcctgtctggatcaaaaaaagatgtcttttgtcc

SEQ ID NO: 9238 - DNA, 1692 bp, Zea mays
ccggatacagcacggaactccagttcaccgctgcctttcttctactgttcaccccgcgtgcgctcgctcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccggaggattttgcaagaaacaaaagccgaacaacacatccacaagctcttacttctcggtgctggagaatcggggaagtctacaatatttaaacaaataaagcttcttttccaaactggctttgacgaggcagagcttaggagctacacatcagtcatccatgctaatgtgtatcagacaattaaaatattatatgagggagctaaagagttagcccaagtggaaccagattcttcaaaatatgtcttatctccagataatcaggagattggagaaaaactatcagaaattggtgccagattggaatacccatcgttgaacaaagaacgtgtacaggatgtaagaaaactatggcaagatccagccattcaggaaacttattcacgtgggagtattctgcaagtcccagactgtgcacagtacttcatggaaaatttggacaaattatctgaagaagattatgtaccgacaaaggaggatgtgcttcatgcaagagtacggacaaatggtgtggtagaaactcagtttagccctctaggagagagcaaaagaggcggagaggtctataggctgtacgatgtaggaggccagagaaacgagagaaggaaatggatccatcttttcgaaggtgttaatgctgtaatattctgtgctgccattagcgagtatgatcagatgttatttgaggatgagacaaagaacagaatgatggagactaaagaactctttgattgggtgctaaagcaaagatgttttgagaaaacctcattcatgttatttcttaacaaatttgacatatttgagagaaaaatacaaaaggtccctttaagcgtgtgcgagtggtttaaagattaccagcccactgcacctggcaaacaggaggtggaacacgcctacgagtttgtaaaaaagaagtttgaggagctctacttccaaagcagcaagcctgaccgtgtcgaccgagtgttcaagatctacagaacaacagccctggatcagaaacttgtaaagaagacattcaagctgatcgacgagagcatgaggcgttccagagaaggaacttgatcgaggatgtggtgttataagccacaagacaagtaactaggatggtgtgaggagcagaaagtttacagtgtcgcggctttggccgattgtgattctttttacatgaggaacatttgttgatctctttgccccaccacaagccagtaaaagtatctgttttgcgctggtcttggggaggtttgggtcgtctccatttccccccaatgttaggacaaaatgtacttaccatcttttggagctctgcctgtttggcctcacaatatcaagttcattcgttgttgccg

SEQ ID NO: 9239 - DNA, 867 bp, Zea mays
ctcgaggccggccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggtt

SEQ ID NO: 9240 - DNA, 827 bp, Zea mays
ctcgaggccggccgggatcgcttatcatctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtggctgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaaaaagttggtttag

SEQ ID NO: 9241 - DNA, 824 bp, Zea mays
ctcgaggccggccgggatcacttatcatccccatccgcacctctctccatctccctgctcctccgcctccttcttgatccagccaagccagggatcgccatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggtttgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatgtggttacattctggaccctgtattttctatgcttttatgcccctactgtttagtattaattatcaataaatttgtttgggacggttg

SEQ ID NO: 9242 - DNA, 995 bp, Zea mays
ctcgaggccggccgggacccgcccggtctccagaacagacaacccgtccttctccttcccatcggctccacacaaccagaaggttcttcgcttcactctgccctgcgccgccgccaacgctgcagccgcagttgccgcaggcgggaacttggacgtgctactcgcgactgctctcatctgttcccgcgtaggattcgttcacaatggcccgtgtgtatgtcggcaacttggatgcacgcgtgacttccggggaactcgaagatgagttccgtgtgtttggagttctgcgaagtgtttgggtcgcacgcaaaccacctggttttgcatttattgattttgacgacaggagggatgcagaggatgctattcgtgatttagatggtaagaatggatggaaagttgaactatctcgtagcaccaatggtcgtggcagtcgtgatcggcatggtggatctgagtcaaagtgctatgagtgtggtgagactgggcactttgcacgtgaatgtcgtctgcgcattggctctggaggtctaggcagtggaagacgtcgcagcaggagcaggagccgcagtcgcagccctagataccgcaggagtccgagctataatagaaggagctatagccctcgttatcgttctccaaggcgccgtactccttcaccggctcgtggacgcagctatagcaggtcgccatagtacaactgtgacaaatatgcatctccctcgttaacggagtaatgatggcagatactggtgtagcaggagcttggcctgaagcccgtgcctgattcttctctgtgtgaggacttggttcttggtttggctgtggggaacaaatttggaactgtcgtcaactgcatgacttcagttcaggtttaaaaccttatctagcttattgtgattgtcttgattatgccattaaagaacttttaagatttgtgtattatgccactaagacatattaccttctctgtgttaaaaaggcatgttctgcgt

SEQ ID NO: 9243 - DNA, 933 bp, Zea mays
ctcgaggccggccgggatccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggtatccctcttcctaacgtcaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctgaggaggaagaggagatccgcagggagaaccagtgggccttcgagtaaggaggtgctggatctattgatgcctaagtttggtggtgtctactactatgtctactttatgttgtcctaatggttgtaagtattttgggagtcactttgcttgcgaatgtctcgcgtaagacttatgttggtcaatggtcggttattaacttattaccatgaaagcacttcgtctgctgccctaagaggtttagtcccatttgcattataaccaattcaatccttgtggatgatttgtgtgattccatcgtgaatctcatggtaaaatattttcattgt

SEQ ID NO: 9244 - DNA, 2137 bp, Zea mays
gacgtcgccgagaaaactcaaatcgaatccccaaatccttcgccggcgattccactccaagtctcgatcggaaaagcgcagaagagcaacggaatcccaattcccaaagggacaaggcaaagctaacttctccttcttcccatccttcctcatcccgtcggatcaatgccagcgggagcaaattcgaagccgctgccgaaattgtggccggttgaccggtgtttccagcccatccccccgttgcacgcggcgaggtagaggagtttccgccgtcaactccatccgatcggcgtagggtcgcggggtgccgacaactttggtccccgctccccacttgggcgccacggtcgctgcgcatgccgcgggctcccgcgcccactggaccccggtaacaccgacggcgcctcgctccgcgtgcccgcccgctgccagctccatgccaaccgccgcggctacataggtagctgcgcgctggctgaaggctcctgcagtgcgcgttgaaggctttcgctgcgtgttgtgcgttctgcttgaatttcggtctgagtttggatgggccagatgatttcgggtgataaatccgacgaacagacagcacgcgacgatggaatcatcaagaatggaagggaaatcctatttcaggcttttaactgggaatccaataagcacaactggtggagtattttggaggaaaaagtaaccgatcttgcggaatctgggtttacgtcagtgtggcttcctcctccaacacagtcattatcccgagaaggctatctaccacagaatctgtactgccttgactcatgttatggttccctccatgagctaaaattgttgcttcataaaatgagcgaacataatgtaagggctatggcagatgttgttatcaaccatcgaattggaactactcaaggatccaatggcatgtataatcgttatgatggcatcccagtatcatgggatgaacatgctgttacatcttgttctggcgggaagggaaacaagagcactggggataactttgatggggttcccaatatagatcatacacaaccatttgtacgcaaagatattatcgaatggttgatctggcttcgaaaatcagttggttttcaagattttcgctttgatttcacgaaaggttatgcagccaagtttgtaaaagaatacattgaggaatcaaaacctctttttgcagttggggaatactgggatagctgtgaatatagcccccctgactaccgactgaactataatcaagatatccataggcagaggattattaattggatagataacactggaggactttgtgccgcatttgatttcacgacaaagggcattcttcaggaagctgtcaaaggagagttgtggcgtttgcgagattcagaaggaaaaccacctggtgtgatgggatggtggccttcaagatcagttacatttattgaaaatcatgacactgggtccactcagggtcattggccttttccgtcagatcatattatggagggatatgcttatatactcacccaccctggcatccccacggtgttctatgatcacttctatgaccagggtgtgcctctccatgacgaaattgctaaactgatgcaaatcagaaaatgccaagatatacatagccgttcatcaatcaaaattctggaggttgggtcagatctgtactcagcaatcatcgacgataagttgtgcatgaagatcggggacggctcgtggtgcccaagtgatccagagtggaggctggcagtctctggtgacagatatgctgtgtggcacaagtgaagcatataagtgccctcgatacagtttatttctgctctcaggaacaggagtaattagcatgttagctgaataacagcacggtaaaacatgccaaaaatgaccctcttcgaggttttacctgtacaagaggagtgcctaaatgcaatgcttaattagaaatacgtgagatcgtgcggctggtcccgaggtgagacatacattttgctaatcgcaacaactatggattacctgcaaaagaaatatatatagggcatgtgatgtctctgtggaatattttatcctggaaccagaaatttgaattatttttataaaaaatgcatctgtgcaatttacattc

SEQ ID NO: 9245 - DNA, 908 bp, Zea mays
ctcgaggccggccgggccgggctcccgtcagcagtagaggcgcgagaagcttatcgcttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggctgctgggtgtcgtacctacctgacttatcattatctgtggttacattctggaccctgtattttctatgctttcatgtctctctactttctagtattaattatcaataagttggtttggaatggttgaaaaaaaaaaaaaaaaaaagcccctagggccctcgag

SEQ ID NO: 9246 - DNA, 878 bp, Zea mays
ctcgaggccggccgggccggggaagcttatcgcttatcatccgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgctgaaggatgttggccccaagtaacttccttggctttggagacggaaccctactctatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggt

SEQ ID NO: 9247 - DNA, 1858 bp, Zea mays
taccctcgaggccggccgggccgggaaggaaaaagcattccaacgctgcatctgcactgcacggtacctcatcctcctctatctctaagaatttaaaagagaaggaggaggaaagtcctcgactgctcgttccataaaccctaacctcgttggattctcggcaaaaatcctcccaattcggaaccctccgatgttccagctacctgcgggagctgagccgtgctcggtttggcgaaattttgcacccctcttgtgctaggaccacccggttcaagctgttcctcgctcctcggaaggatcaggtcttcaccggtgctctccggcgccggatccaggtttgtttcggcgagaggtcgggctcttggcgggggccagcccagcttcgagctcaatttgccggcctgagatggaatcgcgactgcggtgccggtgccggtggctcagctagtcgcgtcgagtcgacgcgcgattcctgccatttgggtgggccagcctttcctggcaatctcggggggcgtttcgcctcgctgcgtggcagaaaggtgtgacgtgtgatgcatcccaaggcacgaatccacgccgacccggtgcgcgaggtcgaccacttcgactgcctgccggattcgctcgtcctgctcatcctgaacaaggtcgaggacgtgcggtcgctcggccggtgctacgccgtgtccaagcggctctgtgggctcgtttccctcgtccatgatgtgtatgtcaagattgaccgcgtcgttgcggtcgacggcgacgccgagggcacgctcaacctgtcctcgccgaagcctcggagcatcttctcgcacttcctgaagctgatgctcttcacaatcatcaagccgttccacaacatgcgcagccctaatggtactgcgaggccattgttcccgcagctctcgcagcactcaccggcacaggtgctcaggaacttcacgcacgtcaggaaccttcggatcgagctcccctctggggatgtgggtactgaggagggagttctcctgaaatggcgagcagagtatgggagcacacttgagaattgtgtgatcctggggggtacccgggttgaccgcaagcctgttggtggagagcatgagccagctttggaggacaatggaagcatgccagagtctttctataccaatggtgggctgagacttcgtgtcgtctggacaatcagctctctaatcgcggcatcaacaaggcactatcttctccgctcaatcatcaatggccatcccacactacagagcttggtactgacagatgctgatggccaaggcacattgtgcatgggggcaaagcagctggaggagttcagagagaaccagttgtcgacctcggcatgttccaacaggactcaggtcccagcctgcaacatgaagctcaagtatgctccatatgttgaactgcctggtggtatggcgttgcaaggcgctactttggtggctatcaaaccctcacctgagggaagcaatggaagccaccctaaccgcaaggaagccgaaggattcgtctttggagcattcgatgggccatttaaagctgctgtgaaggcgctgatgaagagacgcacttaccttctggagatgaatggcttctaggaatcttggtatctagcttgttggtgctatgcatggtacatttagctgagtgtctcatatgtgtaatattcaagaaggcaccatctctagttttgatgcttgctgtctgctgttttagctatttgtacagtgttaacatttggttagataaagatcatatcaagtcctctagcgcaatagtgaatctctctacagttcaccgaaaaaaaaaaaaaaaaggcccctagggccctcgagct

SEQ ID NO: 9248 - DNA, 1500 bp, Glycine max
gtctattctcattttctctctctgtctctttgctccatttcagtgctctgtcttctcccccaccaccgcactctctcagatattatcatttcatatcacacattcacatcctatcatcatcgacaacacgctatccccattgcttcttctcttctccctctctcgtttcctacttgacggcgccgtttcgttctccagaagatgcttctgagtacttcgcgctgcaactagacatgatgagttcaagtttcaagacatgggctgtgggatttgcacttggaaatgaaggagaggcaacgttggagagctgaagaggatgctttattacgttcttatgtcaaacagtatggtcctagggaatggaatcttgtgtctcagcgcatgaacacatatcttaacagggatgctaagtcgtgcttggagaggtggaagaactacctcaagcctggcatcaaaaaaggctctcttactgaagaagagcagcgccttgtcatccaccttcaagcaaaatatggaaacaaatggaagaaaatcgctgctgaagtcccagggcgcactgctaagcggttaggcaagtggtgggaagtcttcaaagagaagcagcagagagagaaaaaggagatcaatagaattgccgacccaattaacaatagtaagtacgagcacatactcgagagttttgcagagaaactagttaaggaacgcccttcaccatcatttgtcatggctgcttccgatggggcatttctgctcactgatacaccagcacctgcatcttccttgcgtccttcttggctttccaattctagtagtgctgcagccatcggcccaagttccctttctgtgaaactaagtctttcttcctcaacggtggccacacctccattttcatggttgccacccgagagaggaccagacaatgctccttttgttttggggaatgtatcagcgcttcatggagctattccaactctaagtgatagcatgcatatgtctcagatggtggagcactgtaaagagttggaagaggggcatcgtgctttggccacgcacaagaaggaggcagcttggaggttaagtcgggtggagttacagttggagtcagagaaggccaaccgaagaagggagaagattgaagaatttgaagcaaagattaaagctcttcaggaagaggagaaagctgctttaggtagaattgaagcagaatacagagaacagttagctgcattgaggagagatgctgaaaacaaggagcaaaagttggcagaacaatgggatgcaaagcatttacggtttactaggttactagagcaattaggatgcagagcagggctccttgagccaaatgcaagatgaagatatattttggcaaaatggatattggtgctcttctgactaaaattatatgcagtttgtgatcttggtatatttttattttagacgtgtatgaatttcctatctattcatacaacttgagtaacttccgttaacagttgaatt

SEQ ID NO: 9249 - DNA, 823 bp, Brassica napus
actactctcatcaatcatggcggcttcaatcgcgaaacccatctctgcaacctctctccgtttctactccgaccgaaagaacaacatttccttctcagattgcatctcgatatcttctgggttccgacattccccaccgtcttccctcgatttggtcgcaaaaccaccaccgaccaaggctcgcgtttcccatctcgttagagcccaaagctcttatgattatattccagactcaaagttttacaaggtggaagcaattgtcaggccatggagaatccagcatgtttcatcggctttactgaaaattgggattcgaggtgtgacggtttctgatgtccgagggtttggtgcacaaggtggatccaaagagagacatggtgggtctgagttctctgaagacaagttcgttgctaaagttaagatggagatcgttgttaagaaagaacaagtggagtctgtaatcaacaccataatcgatggagcaagaacaggagagatcggagatggcaaaatattcgttttgcctgtgtcagatgtcataagggttcggacaggtgagcgtggagaacaagcagagaagatgactggtgacatgctttcgtcatcttaggcacaaacaagagcttaagaatggcgtaataataaaatgaatggatgtgtttagttttctgttttgttgctgagttgatcaagatgtgtgtttaaactgtacatgaatgatgcagaaacatctgtcttggttctcagactgttcctagtaaaaacatgtagtccctgtttcatgtccttgtccgattatgaatccactagtatctatgttgtc

SEQ ID NO: 9250 - DNA, 768 bp, Zea mays
ctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagt

SEQ ID NO: 9251 - DNA, 1943 bp, Zea mays
gtcatttatttttgtcaggctagtcgatccaaataattccatactataacgtcttgtagtagttattttatgattgcttgtgccaaccttaaatttgctaacagtgccaaacttgacagagggcctatcgaagcatctcacaaactgtgttcactcaaaattgtctttcagccgattcctgcaatttcgggatccacgtgcccagaggcgacatccccttgttgatcccatggtcgtttcagagatccggcgatgcctcaacgaggggattgaattccaaggcgagctgctaaatttccggaaggatggcgctccactttacaacagattaagtctcattccaatgcacggggatgatggctacgtgacacatgtgattggaatccaactattctccgaggcaaacatcgatctcagcagcgtgtcgtatccggtgtacaagcaacagaccaacaacaggcccatcattcaagatctgaactcagcttcccatgagcatgctccgaaagtccagagtgcagaccactgcggtatacttcagttgtcagacgaagttctcgcacacaacattctgtctcgcctgtcacctagagatgtcgcatccattggatccgtctgtaccaggatgcatgagcttaccaagaatgatcacctgaggaagatggtctgccagaacgcgtggggaagggatgccactgtcaagcttgagatgagcaccaagatggtaggatggggccgtcttgcgagagagctaactactcttgaggccgcctcgtggaggaagttcacggttggagggcgcgtcgagccttcccgatgcaacttcagtgcctgtgctgttggtaaccgcctggtccttttcggaggggagggtgtcaacatgcagcctatggacgacacctttgtgcttaacatggaggctgcaaggccggaatggcgccgcgtgaaggtttccgcctccccaccaggccggtgggggcacactctgtcgtggctgaacgggtcatggctggtggtatttgggggctgcggacagcaaggtttgctcaatgatgtcttcgtccttgaccttgacgctcagcagccaacgtggagggaggttgcaagcgagggtcctccactgccgcggtcctggcacagctcatgcaccttggatggttcgaagctggtcgtctccggtggctgcaccgagtctggtgttctcctcagcgacaccttcctgcttgacctcacgaaggagaagcctgcgtggagggagattcccacatcttggtcacccccatcccgcctcggccacaccatgtccgtctacggtacgactaaactgctcatgttcggtgggctggcgaagagcggctcgctccggctgcgctccagcgacgcctacacgatggacgtcggcgaagatagtccgcagtggaggcagctggcgacgaccggattcccaaacgtcggcccaccgccgaggctcgatcacgttgcggtgagcctgccctgtggacggatcatcatattcggtggctccatcgcgggactccactccccggcgcagctgttcctggtcgatccagcagaggagaagccgacgtggaggatcctgaacgttcccggcaaaccccccaagttcgcctgggggcacagcacctgcgtggttggcggcactagggtcctcgtcctcggaggccacaccggggaggagtggatactgaacgagctacatgagctctgcctggcaagcaggcccgacgacgacgacgatacggctactgactagtttcgttgcacatggtgttttatatgctattgttcgtaactacttccagtctgttgttgggtaatcggtatgacaaaaaatagcggaaaattaattaaaaaagttagcctagaagatttcagtgtattttatcggtctagatagattctatatggtctatatatacctc

SEQ ID NO: 9252 - DNA, 1113 bp, Zea mays
caccatggagtttgtagtgtttggtttacaaggtaacttccgcgttcgagccccaccgtgacgatgaggtttgggatgaacttgggcggggaaacgagcaaaagaaaacagaatagaacaaacgaaccggcttcagcccatgcgaaccaggagaagcggtgggtgctgtctgatttcgaggttgggaaacctcttgggaggggcaagtttggccatgtttatcttgccagagaaaaaaggagtagtgagattgtggctttgaaagttcttttcaagagccagctcaagcaatcacaggttgagcatcagctgcgacgtgaagtggagattcagagtcatcttcgtcatcctaatattcttcgcctgtatgggtacttctatgatcagaccagggtttacctaatcctggaatacgctgccaagggtgaactgtataaggaactgacaaggtgtaaacatttttcagagcgacgcacagcgacttatgtcgcttcgttggctagagctttgatctaccttcatggcaagcatgttatccatcgggacattaaaccagagaatcttttagttggagttcagggcgagatcaaaattgccgactttggctggtctgtgcacaccttcaacagaagacggactatgtgcggaactctggattacctgccacctgaaatggtggagaaggcagaacatgattaccatgttgatatatggagccttggtgttctgtgctatgagttcctttacggggtcccacctttcgaagctaaggagcactcagaaacctacagaaggatagtgaaagtcgacttgaagttcccactgaaaccattcgtttcacctgccgcaaaggacttgatttctcagatgctggtcaagagctcggcgcagcggctgcctctccacaaggttcttgaacacccgtggatcgtccagaacgccgacccttccggcgtgtacagagaaggtagatccatctaagcttctgtcgcagtgtcgcccgagctgccccaccccaaactgtttggattagcgtctgtttgatgggtgggccctgggacgtgacttgatacggcaaattgccctatactgatgtatcctaccctgttgaac

SEQ ID NO: 9253 - DNA, 1448 bp, Zea mays
ggcgaccataactaagatgtgagatttggtggcgtcagctcggctggtgggtgattcttggtgcgtacacagacacatccctggaggcctggaggcttggcgaggaggacagtgcaggagagagatgtctttcaggagcctgattcaggacatgaaggacgagttcgggagcatctcgcggcacagcctgcggtcccggtctcaccgctccgccgggaacgcggcgcgggcggtggccgcgggaccgtcggaggcgatggatcagagctgctggtcgcagctgccccccgagctcctgcgggaggtgctggtgagaatcgaggcatcggagagctggtggccagcgcgcaaggacgtggtgtcaggcgccggcgtctgccggacctggaggggcatcatgaaggaggccgtgcgcgtcccggaggtgtcagggaagctcacgttccccatctcgcttaagcagcctggcccaagggatggcactcttaaatgtttcatcaggaggaatcgaactactcagacatattatctgtatattggattgacagaagcattggctgatgatgggaagtttctacttgctgcacgcaagtgtcgtaagcccacctgcacagactacctaatttctcttgataaggttgatatgtcaaagggaagcagcacctatattggcaagctaagatcaaacttccttggaacaaagttcactgtctatgatgctcatccaccatatgatggagctgcggtctcaaagagtcgctctgcacgtgtggttggtttgaagcaggtctcccctagagttccggctggaaattatcccgtttcacatatttcttacgagctgaatgttctgggctccagaggtccaagaaggatgaactgtgttatggattccatccctgcatcagctgttaaggaaggagggaaaactcctacacagactgaatttccacttagcagccttgactctttcccatcatttccattcttcagatctaaatcagctcggatagacagttcaacgtcgcaatcatccagtcagagggaagataggttggtgctgaagaacaagtctcctaggtggcacgaacaactgcagtgttggtgcctgaatttccgtgggcgggtcactgttgcctcggttaaaaacttccagttggtggcttctgaggacaatggaccagagagccaagagagtgacaaggtgattctccaattcggaaagatcggaaaagatttgttcaccatggactacggttatccaatatcggcatttcaagcttttgcaatttgtctgagcagttttgatacaaaaattgcctgcgaatgaggcaaggtgatttccccccttctctattccccttgcttgtattatggacatgcagtaaaattttattgaacatgcaatttccaatgtcaaggatgattggatgaagctctccacacat

SEQ ID NO: 9254 - DNA, 1116 bp, Zea mays
cacgcccgcagcgcctcgcctcggctgctctacctctatcccgcgacccgcgagatcggaatcgcggcgccccgccgccctcctccaaaatggcaccgtctctgctcggggggttcaccaagtcgttggccatgacggtgctctccgagatcggggacaagaccttcttcgccgccgcgattctggctatgcgccatcccaggaaactcgtattggcaggctgtttaactgcactaatagtcatgacagctctatcggcttctctaggttgggttgcaccaaatctgatttcacgtaaatggactcatcatttgaccactctattgttctttctatttggcatttggtcattgtgggaaggcttcaaggaagatggagattcggaagaattggctgaagttgaagcagagctggatgctgcctttaagagtaataaaggtgaatctaaaaataaatttaaggcgaatgatgatatgaagaaacagcaaagaccatttctcatgcagttcttctcaccaatttttctgaaggcattttctattacattctttggtgagtggggtgacaagagccagattgctacaattggcttggctgctgatgaaaacccgttcggtgttgtcctgggtggaatcatagcgcaagcactctgcactactgctgccgttcttggtggaaagagcctagcgtcccagatatctgagaagatggttgaactgtcaagcggagtgctcttcctgctcttcggtatcatgtccttactctctggaccagaaggagaattgtaatccctgcttgagcctttttcagctagctgattaacatggctttctcttcttagacctatcttatttcagtacatgaatgatggcaacgaaagccatccatccatggcgaacaggatggtgatttaacagtttagccgacacgctgtaaacatttcagtcgcccttcaaaaattactacatgttacagaagtctgtagcgattgtatatttgtattctgtcgtgcccagcacgtgaaattttgttatcgcaattacatgcgttaacaaagctttgttcgtgaacctattcaggcaattaatatggggcttatagcaggcctttgtcttt

SEQ ID NO: 9255 - DNA, 2313 bp, Zea mays; identical to SEQ ID NO: 8526

SEQ ID NO: 9256 - DNA, 839 bp, Zea mays
ctgcgcctctacatttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaatgcatgaagtttctttggtt

SEQ ID NO: 9257 - DNA, 1359 bp, Arabidopsis thaliana
cttgttcacaaaaagattacttttcttattggtcctgaagtctctgctcattttttcaaagcttctgaatctgatcttagtcagcaggaagtgtatcagttcaatgtccctacttttggtcctggagttgttttcgatgttgattattctgttcgtcaggagcagtttcggttcttcactgaggcacttagagttaacaagttgaagggttatgtggatatgatggttactgaagctgaggattacttctctaaatggggagagagtggtgaagttgatattaaggttgagctagagaggctcatcatcttgactgcaagtagatgtttactgggtcgagaagttcgtgatcagctttttgatgatgtctctgctttgttccatgaccttgacaatggaatgcttcccatcagtgttctcttcccatatctcccaattccagctcaccgccgtcgtgaccgtgcccgagaaaagctttcggagattttcgcaaaaatcattgggtcgagaaaacgctctggaaaaacagagaacgacatgctgcagtgtttcatcgaatcaaagtacaaagatggtagacagacaaccgaatctgaagtcactggtttgctcattgctgctctgtttgcaggacaacacacgagctctatcacttccacctggaccggtgcttatctgatgcgatacaaagagtacttctcagctgctcttgatgagcagaagaacctgattgcgaaacatggagacaagatcgatcatgatatcttatccgagatggatgttctctaccgctgcattaaggaagcgttgaggcttcaccctccactcatcatgttaatgagagcctcgcacagtgatttcagcgtgacagctcgggatggaaaaacttacgatatcccaaagggtcacatcgttgcaacctcccctgcatttgccaaccgcttaccgcacatcttcaaagaccccgacacctacgacccagaaagattctcccctggaagagaagaggacaaagccgcaggggcattctcgtacattgcattcggagggggaaggcacgggtgccttggagagccgtttgcttacctgcagatcaaagccatatggagtcatttgttgaggaacttcgagcttgagctagtttcaccgttccctgagattgactggaacgctatggtggttggagttaaaggcaatgtgatggtgcgttacaagaggcgccagctttcttaaagacaagtttaaggttattgcagctttggatttttctctctggtttctgctttgcttttgtccctctctggttttagttttgttgttgaataattcttctgtttttataaactgttgttactcttt

SEQ ID NO: 9258 - DNA, 761 bp, Arabidopsis thaliana
gcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagt

SEQ ID NO: 9259 - DNA, 440 bp, Glycine max
aaataggtgctaacatcgcctggccaaattcagatttcattaacaaggaatatccattcattgtgggcggtttaatggtccgtttcaacttgtttagattagtttggaggacgatttttgtaatattggccacaattcttgcgatggtaatgccgttttttagtgaggttctttcccttcttggagcaattgggtttgggcctctagttgtctttattcccatacaaatgcacattgctcagaaaagcattaggaaactatcattgaggtggtgtggactccaatttttaagttgcctgagctttattgtttcactgggcgctgtggtaggttcagttcatggaattattcaggatttccacaaaagcgaccttttcatgtacaaacaatagtccctttggaaaccaaaatctgaaataaatacctttctatattaatat

SEQ ID NO: 9260 - DNA, 1539 bp, Glycine max
gcaaaaagaaagaaagaaacaaagatcgttcattgctttgtagtaagatcagatcatcaaaaatggttttgtcttggtcaagaaggaacgttttccgccgtgccaagaaggagaagtcacaaactcaattggaagtggaggttgtgattcccaaccactttcactgcccggtgagtctggagctgatgacagacccagtgactttatcaaccggcatcacctacgaccgtgtgagcattgagaagtggatcgagggagggaacagaacctgccccgtcaccaaccaggtgctgacaaccttcgacatcatccccaaccacgccattcgcaggatgattcaggattggtgtgtcgaaaatagttcttatgggattgatagaatccccacacctcgtattcctatctcggcatacgaggtttccgacacgtgtaccaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggtgcttttggaggaggttttggaggtgatgacatggatggtcccacttggggaagagggtgtttctaaattgagttcaggagcttctttgaattcgttggtatggtttctagaggggaaagaccttgcatcaaggcaaagtgctgctttgttgcttaaagaagtgtgtgttcaagaattggccaaggttggagaagttgttgaagctttggttaagatggttagggagcctattgggagcacttccaccaaggcttgtttggcaacaatttttaacttggtgtcgttggctgcgaatagagagggaattgctcaaagatttgtggagttgggtttggtttcacttttgctagaggctattgttgatggagagaaaggggtgtgtgagaaggcacttggggtgttggattgcatttgtgattgcgagaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagccccaaggagaatgctaccgggttgttgaaactgttgaatggttacaggaacaaagcggagtgcactgactcatcattgaatttcgagcatcttaagaagccattttaattagtgatgaatggcaactagattcatttattctttttttttttttgtgtaggtcaatttattgatacagaattctttgctgtaaaaagatacacacatcaattgattctttgaattcattctttggaaaattgattcgaagtaattagttagatataataatcatggttgtggcaaatac

SEQ ID NO: 9261 - DNA, 2361 bp, Glycine max
ccaagaacgggtagatacagtgctgatgcagcaggtggagatgctgcagttgagttgacacggcgttgtaggcatgcggctgctgctattggtgacttaatttttatttatggtggtttacgtggtggtgtcttgctggatgacctacttgttgctgaagatcttgctgctgctgaaacaactgctgcttcacatgctgctgcagcagcagcagcatctaatgtacaggccggacggctacctggacggtatggatttattgatgataggacaaggcaaaccatgcctgaaacagatcctgatggttcagtagttttgggaaatccagttgccccccctgtaaatggcgacatgtatactgatatcagcactgaaaatgccttgctcccgggatctaggcgaacgagcaaaggagttgagtatctagttgaagcatcagctgcagaagctgaagctatcagtgccacactggctgctgctaaggcacggcaagtgaacggtgaagttgaattgcctgaccgagaccgtggggctgaggcaacacctagcgggaaacaaatatcttccttgattaagcctgattctgctgggtcaaatagcattcctcctggtggagtgaggctgcatcacagagctgtggttgttgctgcagagactggcggagcattaggtggcatggttagacagctttcaattgaccagtttgagaatgaaggcaggcgggtcagttatgggactcctgaaagtacaacagctgctagaaaattattagaccggcagatgtctatcaatagtgtcccaaaaaaggttgtagctcaccttttaaagcctcgtggctggaaaccaccagttcgtcgacagtttttcttggactgcaatgaaattgcagatctttgtgatagtgcagaacgcatattttcaagtgaaccgagcgtgttacagcttagggctccaattaaaatatttggtgatttacatgggcaatttggagatctcatgcgcctctttgatgagtatggtgcaccatcaactgctggtgacatagcatacattgactatctattcctcggagattatgttgataggggccaacacagcctggaaactatcagccttctgcttgctctgaaggttgagtatccaaacaatgtacatttaatacgtggaaaccatgaagctgcagatattaatgccctttttggtttccgaattgagtgcattgagaggatgggtgagagagatggaatttggacatggcaccgtataaaccgtctgtttaattggcttcctctggctgccctaattgagaaaaaaattatttgcatgcatgggggtattggccgttcaataaatcatgtggaacaaattgaaaatattcagcgtccaattacgatggaagcaggatcaattgtgcttatggatctattatggtctgatcctacggagaatgacagtgttgaagggctgcggccaaatgctaggggtccaggattagtcacttttgggcctgatcgagtaatggaattttgcaacaacaatgatcttcagctgattgttcgtgcacatgaatgtgtgatggatggctttgagcgttttgcccaggggcatttgatcacacttttctctgctacaaactactgtggtacggcaaataatgctggggcaatattagttttgggtagagatctcgttgtggttcctaaattgattcatccattaccgcctgcaatttcttcaccagaaacgtcaccggaacgtcatattgaggatacatggatgcaggagttgaatgctaacagaccaccaacaccaactagaggccgtcctcaagtaacaaacgaccgagcatgatgccgtttacagggtattcgagcttacccgctgaaagcttcaaggatcaagcttttatttgtcccggttctcatcgctcaatcatctggcctgtagacgatacaagttcgagaagcaagcaaagttggtagccactgctaggttggttcaattgacaaaagctagaagttgcagtatgggttcctacccacctgttgtaaattgagccctagggtacaaaatcaaggtcatggatgtccgtgtcatggaatgtcagtgctggctatttttctcattattttttacatattttttttactcattgtccctaggttattgtttttttttcaatttatatttttaaatcaagaggacaagggttttttttttcctgtgatggtgagatatataaatcagaaatctttcttgggggtccatgtatcatagggttgtgtagttcccatccatgctctgtacaactaatttttgtgtgaatcaacatattctgacagaaatgtgaattttgagaat

SEQ ID NO: 9262 - DNA, 1506 bp, Glycine max
caagaagcctcttcagagatattgcctatcaattttgatggactggctaaggcagtgaagaagggagacactatttttattggtcaatacttgttcacaggaagtgaaactacttctgtatggctagaggtatctgaagtcaaagggcaagatgttgtttgtattataaagaacacagctacattggctgggtcattgttcactttgcatgcctctcagattcatattgatttgcccactctcactgagaaagaccaggaggttataagctcctggggtgttaaaaacaaaattgattttctgtcattgtcatatactcgacacgccgaagatgttcgccaggctcgtgaatttctttcaaagttaggtgatctcagccaaactcaaatttttgcaaagattgaaaatgttgagggattgacccattttgatgagattctacaagaagctgatggtattatcctttcccgtgggaatttgggtattgatcttccaccagagaaggtttttttatttcaaaaatctgccctttacaagtgtaatatggctgggaaacctgctgttcttacacgtgttgtggatagcatgactgacaacttgagaccaactcgtgctgaagcaacagatgtcgccaatgctgttttagatggaagtgatgccattcttctgggtgctgagactttacgtgggttgtaccctattgagactatatctactgttggcagaatttgttcagaggctgagaaagttttcaatcaagacctttattttaaaaggacagtcaagtatgttggagaacccatgactcacttggaatctattgcatcctctgcggtacgagctgcaattaaggtgaaagcatctattataatttgttttacttcatctggaagggctgcaagattgattgcaaagtataggccaacaatgccagtactatctgttgtgatcccccgacttaagacaaaccagctaaagtggagctttagtggagcttttgaggcaagacaatcacttattgtgagaggtctctttcctatgcttgcagatcctcgacatcctgctgaatcaacaagtgcaacaaatgagtctattcttaagtttgcccttgatcatggaaaagcattgggagttattaagtcacatgaccgggtagttgtttgccagaaacttggtgatgcatctgtggttaagattattgagcttgaagattaaactattaaagcgcattcaaccaactacagttttagtgttatttatttatttttacaactttgcctagttatttaaagatgcaggtcgttctgccacaagtagaagttatctctacttggttttgatgaaacaaattttgatgcaaattattaatggctgtcaaacataaaatcaaggcaatgtgcccttgatgccaattttttgagtttaagattcatactagaacacagttcgaaaatgtgattattgaattggattaccaatctaatgaagctaatagcttgttatttc

SEQ ID NO: 9263 - DNA, 1104 bp, Glycine max
gggcgagagagcaactgcacgcactgtaactctctcaccgtttcttccgctttgatggaacagtacgagaaggttgagaagataggcgagggaacatacggcgtcgtttacaagggtcgcgaccgctccaccaacgagaccatcgccttgaagaagattcgcttggagcaggaggatgagggggttcccagcaccgccattcgcgagatttctctcttgaaagaaatgcagcacaggaacattgttaggttgcaggatgtagtacatgatgagaagagtttgtatctggtttttgagtaccttgacttagatctaaagaagcacatggattcatctccagaatttgcaaaagatccacgacaactaaaaatgttcctgtaccaaattctctgtggcatcgcttactgtcattcacgtagagttcttcatcgagacttaaaaccacagaatttgttgatagatcgcagcaataatgcactaaaacttgcagattttggattggctagggcttttggaattcctgttaggacatttacacatgaggtggtaacactgtggtacagagctccagaaattttgcttggatcccatcattattctaccccagttgatatttggtcagtgggatgcatatttgcagagatggtaaatcaacgacctcttttccctggggactctgagattgatgaattgtttaaaatattcagaatcatgggtacaccaaatgaagacacatggcctggagtgacatcattgcctgattttaaatcagccttccccaaatggcagcctaaggacctgaaaattgtggttccaaatctcaagccagctggtcttgatcttctttctagcatgctttacttggatcccagcaaaagaattactgctaggagcgctcttgagcatgaatacttcaaagacattaaatttgtaccctgatttcttatcttcaaggctgaggtgtctatattagtatgtgtagcatttatgggttttgactcaaacgtgtgttgtccttgcttttttcttcaatgctttgtaccgaatcatatttcatttatttgttcttacatttttattttagtatgtgtgatcttgttacct
